United States Patent
Li et al.

(10) Patent No.: US 11,773,171 B2
(45) Date of Patent: Oct. 3, 2023

(54) WNT SURROGATE MOLECULES AND USES THEREOF

(71) Applicant: Surrozen Operating, Inc., South San Francisco, CA (US)

(72) Inventors: Yang Li, Mountain View, CA (US); Tom Zhiye Yuan, Union City, CA (US); Aaron Ken Sato, Burlingame, CA (US); Wen-Chen Yeh, Belmont, CA (US); Claudia Yvonne Janda, Palo Alto, CA (US); Tristan William Fowler, San Francisco, CA (US); Helene Baribault, Redwood City, CA (US); Kuo-Pao Lai, Campbell, CA (US); Liqin Xie, South San Francisco, CA (US); Randall J. Brezski, South San Francisco, CA (US); Chenggang Lu, South San Francisco, CA (US)

(73) Assignee: Surrozen Operating, Inc., South San Francisco, CA (US)

( * ) Notice: Subject to any disclaimer, the term of this patent is extended or adjusted under 35 U.S.C. 154(b) by 197 days.

(21) Appl. No.: 16/954,484

(22) PCT Filed: Dec. 19, 2018

(86) PCT No.: PCT/US2018/066616
§ 371 (c)(1),
(2) Date: Jun. 16, 2020

(87) PCT Pub. No.: WO2019/126398
PCT Pub. Date: Jun. 27, 2019

(65) Prior Publication Data
US 2020/0308287 A1    Oct. 1, 2020

Related U.S. Application Data

(60) Provisional application No. 62/680,522, filed on Jun. 4, 2018, provisional application No. 62/641,217, filed on Mar. 9, 2018, provisional application No. 62/607,875, filed on Dec. 19, 2017.

(51) Int. Cl.
*C07K 16/28* (2006.01)
*C07K 16/46* (2006.01)
*A61K 39/00* (2006.01)

(52) U.S. Cl.
CPC ........ C07K 16/2863 (2013.01); C07K 16/468 (2013.01); *A61K 2039/505* (2013.01); *C07K 2317/30* (2013.01); *C07K 2317/55* (2013.01); *C07K 2317/569* (2013.01); *C07K 2317/622* (2013.01); *C07K 2317/92* (2013.01)

(58) Field of Classification Search
CPC ............. C07K 16/2863; C07K 16/468; C07K 2317/30; C07K 2317/55; C07K 2317/569; C07K 2317/622; C07K 2317/92; A61K 2039/505
See application file for complete search history.

(56) References Cited

U.S. PATENT DOCUMENTS

| | | |
|---|---|---|
| 4,946,778 A | 8/1990 | Ladner et al. |
| 5,091,513 A | 2/1992 | Huston et al. |
| 5,132,405 A | 7/1992 | Huston et al. |
| 6,005,079 A | 12/1999 | Casterman et al. |
| 6,528,624 B1 | 3/2003 | Idusogie et al. |
| 6,538,124 B1 | 3/2003 | Idusogie et al. |
| 6,765,087 B1 | 7/2004 | Casterman et al. |
| 6,838,254 B1 | 1/2005 | Hamers et al. |
| 7,297,775 B2 | 11/2007 | Idusogie et al. |
| 7,317,091 B2 | 1/2008 | Lazar et al. |
| 7,364,731 B2 | 4/2008 | Idusogie et al. |
| 7,657,380 B2 | 2/2010 | Lazar et al. |
| 7,662,925 B2 | 2/2010 | Lazar et al. |
| 7,982,013 B2 | 7/2011 | Gurney et al. |
| 8,202,966 B2 | 6/2012 | McCarthy |
| 8,221,751 B2 | 7/2012 | Nakamura et al. |
| 8,343,922 B2 | 1/2013 | Wu et al. |
| 8,461,155 B2 | 6/2013 | Wu et al. |
| 8,507,442 B2 | 8/2013 | Gurney et al. |
| 8,637,506 B2 | 1/2014 | Wu et al. |
| 8,715,941 B2 | 5/2014 | Abo et al. |
| 8,846,041 B2 | 9/2014 | Bourhis et al. |
| 8,859,736 B2 | 10/2014 | Ma et al. |
| 8,883,735 B2 | 11/2014 | Jenkins et al. |
| 8,975,044 B2 | 3/2015 | Gurney et al. |
| 9,359,444 B2 | 6/2016 | Dupont et al. |
| 9,573,998 B2 | 2/2017 | Gurney et al. |
| 11,142,577 B2 | 10/2021 | Garcia et al. |

(Continued)

FOREIGN PATENT DOCUMENTS

| | | |
|---|---|---|
| EP | 1716181 B1 | 12/2009 |
| EP | 2910550 A2 | 8/2015 |

(Continued)

OTHER PUBLICATIONS

Brinkmann, U. et al. (2017) The making of bispecific antibodies. MAbs, 9(2):182-212.
Adams, T.S. et al. (Jul. 2020) Single-cell RNA-seq reveals ectopic and aberrant lung-resident cell populations in idiopathic pulmonary fibrosis. Sci Adv, 6:eaba1983, 16 pages.
Ahn, V. E., et al. (2011) "Structural basis of Wnt signaling inhibition by Dickkopf binding to LRP5/6" Developmental cell, 21(5):862-873.
Aihara, E. et al. (2017) "Trefoil factor peptides and gastrointestinal function" Annual Review of Physiology, 79:357-380.
Akhmetshina, A. et al. (Mar. 2012) Activation of canonical Wnt signalling is required for TGF-β-mediated fibrosis. Nature Communications, 3:735; DOI:10.1038/ncomms1734, 12 pages.

(Continued)

*Primary Examiner* — Meera Natarajan
*Assistant Examiner* — Cheom-Gil Cheong
(74) *Attorney, Agent, or Firm* — Cooley LLP

(57) ABSTRACT

The present invention provides Wnt pathway agonists and related compositions, which may be used in any of a variety of therapeutic methods for the treatment of diseases.

10 Claims, 132 Drawing Sheets
Specification includes a Sequence Listing.

(56) References Cited

U.S. PATENT DOCUMENTS

| | | |
|---|---|---|
| 2003/0044409 A1 | 3/2003 | Carson et al. |
| 2003/0099647 A1 | 5/2003 | Deshpande et al. |
| 2003/0157109 A1 | 8/2003 | Corvalan et al. |
| 2003/0165500 A1 | 9/2003 | Rhee et al. |
| 2005/0261181 A1 | 11/2005 | Wu et al. |
| 2006/0127393 A1 | 6/2006 | Li et al. |
| 2006/0263791 A1 | 11/2006 | Moon et al. |
| 2007/0196872 A1 | 8/2007 | Bex et al. |
| 2007/0207522 A1 | 9/2007 | Laurie et al. |
| 2008/0038272 A1 | 2/2008 | Buehring et al. |
| 2008/0131435 A1 | 6/2008 | Stavenhagen et al. |
| 2008/0138344 A1 | 6/2008 | Stavenhagen et al. |
| 2008/0267955 A1 | 10/2008 | Schluesener et al. |
| 2008/0286261 A1 | 11/2008 | Morgan et al. |
| 2009/0028869 A1 | 1/2009 | Dodel et al. |
| 2009/0092599 A1 | 4/2009 | Lazar et al. |
| 2009/0291088 A1 | 11/2009 | Hariharan et al. |
| 2009/0311243 A1 | 12/2009 | Brockbank et al. |
| 2010/0129375 A1 | 5/2010 | Junge et al. |
| 2010/0254979 A1 | 10/2010 | Staunton et al. |
| 2010/0254980 A1 | 10/2010 | Cong et al. |
| 2011/0105606 A1 | 5/2011 | Rabbani et al. |
| 2011/0177073 A1 | 7/2011 | Van Berkel et al. |
| 2011/0223140 A1 | 9/2011 | Park et al. |
| 2012/0237523 A1 | 9/2012 | Mascola et al. |
| 2012/0322717 A9 | 12/2012 | Liu et al. |
| 2013/0058934 A1 * | 3/2013 | Cong et al. |
| 2013/0064823 A1 | 3/2013 | Cong et al. |
| 2013/0095097 A1 | 4/2013 | Blankenship et al. |
| 2013/0095104 A1 | 4/2013 | Cummings et al. |
| 2013/0183320 A1 | 7/2013 | Wu et al. |
| 2013/0230521 A1 | 9/2013 | Nakamura et al. |
| 2013/0253172 A1 | 9/2013 | Gurney et al. |
| 2013/0274215 A1 | 10/2013 | Thies et al. |
| 2013/0295105 A1 | 11/2013 | Gurney et al. |
| 2014/0044713 A1 | 2/2014 | De Lau et al. |
| 2014/0105917 A1 | 4/2014 | Gurney |
| 2014/0154252 A1 | 6/2014 | Thompson et al. |
| 2014/0200179 A1 | 7/2014 | Garcia et al. |
| 2014/0242078 A1 | 8/2014 | Dupont et al. |
| 2014/0363439 A1 | 12/2014 | Bourhis et al. |
| 2015/0010560 A1 | 1/2015 | Xu et al. |
| 2015/0119555 A1 | 4/2015 | Jung et al. |
| 2015/0196663 A1 | 7/2015 | Shusta et al. |
| 2015/0209407 A1 | 7/2015 | Pignolo |
| 2015/0266947 A1 | 9/2015 | Sierks et al. |
| 2015/0376252 A1 | 12/2015 | Xu et al. |
| 2016/0002312 A1 | 1/2016 | Ilan |
| 2016/0024196 A1 | 1/2016 | Majeti et al. |
| 2016/0152947 A1 | 6/2016 | Pioszak |
| 2016/0194394 A1 | 7/2016 | Sidhu et al. |
| 2016/0264960 A1 | 9/2016 | Ishii |
| 2016/0312207 A1 | 10/2016 | Kuo et al. |
| 2017/0071937 A1 | 3/2017 | Karp et al. |
| 2017/0218077 A1 | 8/2017 | Raum et al. |
| 2017/0218078 A1 | 8/2017 | Raum et al. |
| 2017/0240631 A1 | 8/2017 | Monroe et al. |
| 2017/0253670 A1 | 9/2017 | Klein et al. |
| 2017/0306029 A1 * | 10/2017 | Garcia .................. A61P 39/00 |
| 2017/0349659 A1 | 12/2017 | Garcia et al. |
| 2017/0355756 A1 | 12/2017 | Julien et al. |
| 2018/0066067 A1 | 3/2018 | Cong et al. |
| 2019/0093072 A1 | 3/2019 | Koehler et al. |
| 2019/0093079 A1 | 3/2019 | Loose et al. |
| 2020/0024338 A1 | 1/2020 | Luca et al. |
| 2020/0048324 A1 | 2/2020 | Zhang et al. |
| 2020/0199237 A1 | 6/2020 | Garcia et al. |
| 2020/0199238 A1 | 6/2020 | Garcia et al. |
| 2021/0079089 A1 | 3/2021 | Li et al. |
| 2021/0087280 A1 | 3/2021 | Li et al. |
| 2021/0292422 A1 | 9/2021 | Li |
| 2021/0380678 A1 | 12/2021 | Zhang et al. |
| 2021/0403578 A1 | 12/2021 | Garcia et al. |
| 2022/0064337 A1 | 3/2022 | Li et al. |
| 2022/0112278 A1 | 4/2022 | Li et al. |
| 2022/0175884 A1 | 6/2022 | Lee et al. |
| 2022/0195053 A1 | 6/2022 | Li et al. |
| 2022/0275095 A1 | 9/2022 | Li et al. |

FOREIGN PATENT DOCUMENTS

| | | |
|---|---|---|
| EP | 3191526 A4 | 3/2018 |
| JP | 2011503025 A | 1/2011 |
| JP | 2012503990 A | 2/2012 |
| JP | 2012506568 A | 3/2012 |
| JP | 2012516685 A | 7/2012 |
| JP | 2013527761 A | 7/2013 |
| JP | 2017530099 A | 10/2017 |
| WO | WO-9627011 A1 | 9/1996 |
| WO | WO-9850431 A2 | 11/1998 |
| WO | WO-02092635 A2 | 11/2002 |
| WO | WO-2004063351 A2 | 7/2004 |
| WO | WO-2005032574 A1 | 4/2005 |
| WO | WO-2006040163 A1 | 4/2006 |
| WO | WO-2006079372 A1 | 8/2006 |
| WO | WO-2006088494 A2 | 8/2006 |
| WO | WO-2006105338 A2 | 10/2006 |
| WO | WO-2007012449 A1 | 2/2007 |
| WO | WO-2007024249 A2 | 3/2007 |
| WO | WO-2007146968 A2 | 12/2007 |
| WO | WO-2007148417 A1 | 12/2007 |
| WO | WO-2008068048 A2 | 6/2008 |
| WO | WO-2008084402 A2 | 7/2008 |
| WO | WO-2008134632 A1 | 11/2008 |
| WO | WO-2009064944 A2 | 5/2009 |
| WO | WO-2009080251 A1 | 7/2009 |
| WO | WO-2010016766 A2 | 2/2010 |
| WO | WO-2010021697 A2 | 2/2010 |
| WO | WO-2010037041 A2 | 4/2010 |
| WO | WO-2010054010 A1 | 5/2010 |
| WO | WO-2010090513 A2 | 8/2010 |
| WO | WO-2011088226 A2 | 7/2011 |
| WO | WO-2011090762 A1 | 7/2011 |
| WO | WO-2011119661 A1 | 9/2011 |
| WO | WO-2011123785 A2 | 10/2011 |
| WO | WO-2011138392 A1 | 11/2011 |
| WO | WO-2012014076 A2 | 2/2012 |
| WO | WO-2012058768 A1 | 5/2012 |
| WO | WO-2012103360 A2 | 8/2012 |
| WO | WO-2012140274 A9 | 3/2013 |
| WO | WO-2013092001 A2 | 6/2013 |
| WO | WO-2013109819 A1 | 7/2013 |
| WO | WO-2014029752 A1 | 2/2014 |
| WO | WO-2014124326 A1 | 8/2014 |
| WO | WO-2014159580 A1 | 10/2014 |
| WO | WO-2015036582 A2 | 3/2015 |
| WO | WO-2015063187 A1 | 5/2015 |
| WO | WO-2015109212 A1 | 7/2015 |
| WO | WO-2016023019 A2 | 2/2016 |
| WO | WO-2016040895 A1 | 3/2016 |
| WO | WO-2016168607 A1 | 10/2016 |
| WO | WO-2016205551 A2 | 12/2016 |
| WO | WO-2016205566 A1 | 12/2016 |
| WO | WO-2017127933 A1 | 8/2017 |
| WO | WO-2017136820 A2 | 8/2017 |
| WO | WO-2017152102 A2 | 9/2017 |
| WO | WO-2018132572 A1 | 7/2018 |
| WO | WO-2018140821 A1 | 8/2018 |
| WO | WO-2018220080 A1 | 12/2018 |
| WO | WO-2019126398 A1 | 6/2019 |
| WO | WO-2019126399 A1 | 6/2019 |
| WO | WO-2019126401 A1 | 6/2019 |
| WO | WO-2019159084 A1 | 8/2019 |
| WO | WO-2020010308 A1 | 1/2020 |
| WO | WO-2020014271 A1 | 1/2020 |
| WO | WO-2020132356 A1 | 6/2020 |
| WO | WO-2020167848 A1 | 8/2020 |
| WO | WO-2020185960 A1 | 9/2020 |
| WO | WO-2020206005 A1 | 10/2020 |
| WO | WO-2021003054 A1 | 1/2021 |
| WO | WO-2021003416 A1 | 1/2021 |
| WO | WO-2021173726 A1 | 9/2021 |

(56) References Cited

FOREIGN PATENT DOCUMENTS

| WO | WO-2022104280 A1 | 5/2022 |
|---|---|---|
| WO | WO-2022192445 A1 | 9/2022 |
| WO | WO-2023044348 A1 | 3/2023 |

OTHER PUBLICATIONS

Alsafadi, H. et al. (Mar. 2017) An ex vivo model to induce early fibrosis-like changes in human precision-cut lung slices. Am J Physiol Lung Cell Mol Physiol, 312:L896-L902.
Antoni, L. et al. (2014) "Intestinal barrier in inflammatory bowel disease" World Journal of Gastroenterology: WJG, 20(5):1165-1179.
Aran et al. (2019) "Reference-based analysis of lung single-cell sequencing reveals a transitional profibrotic macrophage". Nature Immunology, 20(2): 163-172.
Arike, L. et al. (2017) "Intestinal Muc2 mucin O-glycosylation is affected by microbiota and regulated by differential expression of glycosyltranferases" Glycobiology, 27(4):318-328.
Atkinson, P.J., et al. (2014) "Hair cell regeneration after ATOH1 gene therapy in the cochlea of profoundly deaf adult guinea pigs." PLoS ONE 9(7):e102077.
Baarsma, H. et al. (2017) Noncanonical WNT-5A signaling impairs endogenous lung repair in COPD. J Exp Med, 214:143-163.
Baarsma, H.A., and M. Kbnigshoff (2017). 'WNT-eris coming' : WNT signalling in chronic lung diseases. Thorax, 72:746-759.
Bafico, A. et al. (Jul. 2001) "Novel mechanism of Wnt signalling inhibition mediated by Dickkopf-1 interaction with LRP6/Arrow" Nature Cell Biology, 3(7):683-686.
Barbas et al., "Human antibody recognition of DNA." Proceedings of the National Academy of Sciences (1995); 92(7): 2529-2533.
Barbas et al., "Recognition of DNA by synthetic antibodies." Journal of the American Chemical Society (1994); 116.5: 2161-2162.
Barkauskas, C.E. et al. (Jul. 2013) Type 2 alveolar cells are stem cells in adult lung. Journal of Clinical Investigation 123(7):3025-3036.
Barkauskas et al. (2017) "Lung organoids: current uses and future promise". Development, 144(6): 986-997.
Barker et al. (2007). "Identification of stem cells in small intestines and colon by marker gene Lgr5." Nature Publishing Group. vol. 449, No. 25 1003-7.
Barker et al. (2009) Crypt stem cells as the cells-of-origin of intestinal cancer. Nature, 457(7229):608-611, Methods, 1 page; doi:10.1038/nature07602.
Barker et al. (2010). "Lgr5-'-ve stem cells drive self-renewal in the stomach and build long-lived gastric units in vitro." Cell Stem Cell. vol. 6, 25-36.
Barnes et al. (2015) "Chronic obstructive pulmonary disease". Nature Reviews, Disease Primer, 1: 1-21.
Basil et al., (2022) "Human distal airways contain a multipotent secretory cell that can regenerate alveoli". Nature, 604(7904): 120-126.
Bergström, J.H. et al. (2014) "AGR2, an endoplasmic reticulum protein, is secreted into the gastrointestinal mucus" PLoS One, 9(8):e104186.
Bergström, J.H. et al. (Nov. 2016) "Gram-positive bacteria are held at a distance in the colon mucus by the lectin-like protein ZG16" Proceedings of the National Academy of Sciences, 113(48):13833-13838.
Beumer, J. et al. (2016) "Regulation and plasticity of intestinal stem cells during homeostasis and regeneration" Development, 143(20):3639-3649.
Bhalla, P. et al. (Apr. 2015) Disseminated, persistent, and fatal infection due to the vaccine strain of varicella-zoster virus in an adult following stem cell transplantation.Clin Infect Dis, 60(7):1068-1074. doi: 10.1093/cid/ciu970.
Bird R.E., et al., "Single-Chain Antigen-Binding Proteins," Science, Oct. 21, 1988, vol. 242, No. 4877, pp. 423-426.

Blagodatski et al. (2014) "Targeting the Wnt pathways for therapies". Molecular Cell Therapy 2(28): 15 pages.
Bohne, B.A. et al. (1976) Irreversible Inner Ear Damage From Rock Music. Trans Sect Otolaryngol Am Acad Ophthalmol Otolaryngol. 82(1):50-59.
Bourhis, E. et al., "Reconstitution of a Frizzled8.Wnt3a.LRP6 Signaling Complex Reveals Multiple Wnt and Dkk1 Binding Sites on LRP6", The Journal of Biological Chemistry, vol. 285, No. 12, pp. 9172-9179.
Bradley et al., Science, 309:1868-1871 (2005).
Bramhall et al. (2014). "Lgr5-Positive Supporting Cells Generate New Hair Cells in the Postnatal Cochlea." Stem Cell Reports. 2(3): 311-322.
Bramhall, N.F. et al. (2017) Auditory Brainstem Response Altered in Humans With Noise Exposure Despite Normal Outer Hair Cell Function. Ear Hear, 38(1):e1-e12. U.S. Department of Veterans Affairs Public Access Author Manuscript, 27 pages.
Cao et al. (2016) "Targeting of the pulmonary capillary vascular niche promotes lung alveolar repair and ameliorates fibrosis". Nature Medicine, 22(2): 154-162.
Cao, H. et al. (2018) Inhibition of Wnt/β-catenin signaling suppresses myofibroblast differentiation of lung resident mesenchymal stem cells and pulmonary fibrosis. Scientific Reports, 8:13644; DOI.10.1038/s41598-018-28968-9, 14 pages.
Carlier, F.M. et al. (2020). Canonical WNT pathway is activated in the airway epithelium in chronic obstructive pulmonary disease. EBioMedicine, 61:103034; https://doi.org/10.1016/j.ebiom.2020.103034, 17 pages.
Chai et al. (2011). "Dynamic Expression of Lgr5, a Wnt Target Gene, in the Developing and Mature Mouse Cochlea." J. Assoc. Res. Otolaryngology. 12(4): 455-469.
Chang et al. (2015) "Structure and functional properties of Norrin mimic Wnt for signaling with Frizzled4, Lrp5/6, and proteoglycane" Life 4 1-27.
Chen, C. et al. (1995), "Enhancement and destruction of antibody function by somatic mutation: unequal occurrence is controlled by V gene combinatorial associations," The EMBO Journal, vol. 14, No. 12, pp. 2784-2794.
Chen et al. (2009). "Aminoglycoside-induced histone deacetylation and hair cell death in the mouse cochlea," J. Neurochem., 108(5): 1226-1236.
Chen, H. et al. (2020) "Development of Potent, Selective Surrogate WNT Molecules and Their Application in Defining Frizzled Requirements." Cell Chem Biol 27:598-609, e594.
Chen, M. et al. (Jul. 2017) Acute inflammation regulates neuroregeneration through the NF-$_K$B pathway in olfactory epithelium. Proceedings of the National Academy of Sciences, 114(30):8089-8094. https://doi.org/10.1073/pnas.1620664114.
Chen, S. et al. (Nov. 15, 2011) Structural and functional studies of LRP6 ectodomain reveal a platform for Wnt signaling. Dev Cell., 21(5):848-861. doi: 10.1016/j.devcel.2011.09.007. Epub Oct. 13, 2011.
Chen, X. et al. (Aug. 2016). Inhibition of Wnt/β-catenin signaling suppresses bleomycin-induced pulmonary fibrosis by attenuating the expression of TGF-β1 and FGF-2. Experimental and Molecular Pathology, 101(1):22-30. HHS Public Access Author Manuscript, 17 pages.
Chen, X. et al. (2018). The hedgehog and Wnt/β-catenin system machinery mediate myofibroblast differentiation of LR-MSCs in pulmonary fibrogenesis. Cell Death & Disease, 9:639; DOI:10.1038/s11419-018-0692-9, 15 pages.
Cheng, H. et al. (1974) Origin, differentiation and renewal of the four main epithelial cell types in the mouse small intestine. V. Unitarian theory of the origin of the four epithelial cell types. American Journal of Anatomy, 141(4):537-561.
Cheng, Z. et al. (Oct. 2011) Crystal structures of the extracellular domain of LRP6 and its complex with DKK1. Nat Struct Mol Biol, 18(11):1204-1210. NIH Public Access Author Manuscript; 20 pages.
Chilosi et al. (2003) "Aberrant Wnt/β-catenin pathway activation in idiopathic pulmonary fibrosis". The American Journal of Pathology, 162(5): 1495-1502.
Clevers et al (2012) "Wnt/b-Catenin signaling and disease" Cell, 149:1192-1205.

(56) References Cited

OTHER PUBLICATIONS

Conlon, T.M. et al. (Dec. 2020). Inhibition of LTβR signalling activates WNT-induced regeneration in lung. Nature, 588(7836):151-156. HHS Public Access Author Manuscript, 50 pages.
Conte et al. (2014) "Effect of pirfenidone on proliferation, TGF-β-induced myofibroblast differentiation and fibrogenic activity of primary human lung fibroblasts". European Journal of Pharmaceutical Sciences, 58: 13-19.
Cooper, H.S. et al. (1993) "Clinicopathologic study of dextran sulfate sodium experimental murine colitis" Laboratory Investigation, 69(2):238-249.
Co-pending U.S. Appl. No. 17/429,584, filed Feb. 11, 2020.
Cox et al. (2014). "Spontaneous Hair Cell Regeneration in the Neonatal Mouse Cochlea in Vivo." Development. vol. 141, No. 4, pp. 816-829.
Davidson, G. (2010) "The Cell Cycle and Wnt." Cell Cycle, 9(9):1667-1668.
De Lau, W. et al. (Aug. 2011) "Lgr5 homologues associate with Wnt receptors and mediate R-spondin signalling" Nature, 476(7360):293-297.
De Visser, K., et al. (2012) Developmental stage-specific contribution of LGR5+ cells to basal and luminal epithelial lineages in the postnatal mammary gland. J Pathol, 228:300-309.
Degryse, A. et al. (2010) Repetitive intratracheal bleomycin models several features of idiopathic pulmonary fibrosis. Am J Physiol Lung Cell Mol Physiol, 299:L442-L452.
Deng, S. et al (2019) "Bitter peptides increase engulf of phagocytes in vitro and inhibit oxidation of myofibrillar protein in peeled shrimp (*Litopenaeus vannamei*) during chilled storage." Aquaculture Reports, 15:100234. 8 pages.
Desai et al. (2014) "Alveolar progenitor and stem cells in lung development, renewal and cancer". Nature, 507(7491): 190-194.
Deshaies, R. J. (Apr. 2020) "Multispecific drugs herald a new era of biopharmaceutical innovation." Nature, 580(7803):329-338.
Dijksterhuis et al. (2015) "Systematic mapping of Wnt-Fzd protein interactions reveals functional selectivity by distinct Wnt-Fzd pairs" The Journal of Biology Chemist 290:11 6789-6798.
Dorofeyev, A.E., et al. (2013) "Mucosal Barrier in Ulcerative Colitis and Crohn's Disease" Gastroenterology Research and Practice, 2013:431231, 9 pages.
Drucker, D. (1999) "Glucagon-like Peptide 2" TEM, 10(4):153-156.
Ettenberg S.A. et al. (Aug. 31, 2010) "Inhibition of tumorigenesis driven by different Wnt proteins requires blockade of distinct ligand-binding regions by LRP6 antibodies" Proc Natl Acad Sci USA, 107(35):15473-15478.
Farin et al. (2012). "Redundant sources of Wnt regulate intestinal stem cells and promote formation ofPaneth cells," Gastroenterology, 143: 1518-1529.
Fedi, P. et al. (Jul. 1999) "Isolation and Biochemical Characterization of the Human Dkk-1 Homologue, a Novel Inhibitor of Mammalian Wnt Signaling." Journal of Biological Chemistry, 274(27):19465-19472.
Fong, Y.W. et al. (Nov. 2014) "The dyskerin ribonucleoprotein complex as an OCT4/SOX2 coactivator in embryonic stem cells" eLife, 3:e03573, 30 pages.
Fowler, T. W et al. (2021) "Development of selective bispecific Wnt mimetics for bone loss and repair." Nature Communications, 12(1):3247, pp. 1-13. https://doi.org/10.1038/s41467-021-23374-8.
Frank et al. (2016) "Emergence of a wave of Wnt signaling that regulates lung alveologenesis by controlling epithelial self-renewal and differentiation". Cell Reports, 17(9): 2312-2325.
Fuerer, C. and R. Nusse (2010) "Lentiviral Vectors to Probe and Manipulate the Wnt Signaling Pathway" PLoS One 5z92):e9370, 7 pages.
Fujii, M. et al. (Dec. 2018) "Human Intestinal Organoids Maintain Self-Renewal Capacity and Cellular Diversity in Niche-Inspired Culture Condition" Cell Stem Cell, 23:787-793.
Fujioka et al. (2015). "Manipulating cell fate in the cochlea: a feasible therapy for hearing loss." Trends Neurosci. 38, 139-44.

Gadkar, K. et al. (2015) "Design and pharmacokinetic characterization of novel antibody formats for ocular therapeutics." Investigative Ophthalmology & Visual Science, 56(9):5390-5400.
GenBank Accession No. AF177394.2 "*Homo sapiens* dickkopf-1 (DKK-1) mRNA, complete cds" Dec. 20, 2016, 2 pages.
GenBank Accession No. AF177395.1 "*Homo sapiens* dickkopf-2 (DKK-2) mRNA, complete cds" Dec. 20, 2016, 2 pages.
GenBank Accession No. NM_014419.4 "*Homo sapiens* dickkopf like acrosomal protein 1 (DKKL1), transcript variant 1, mRNA" Feb. 18, 2021, 4 pages.
GenBank Accession No. NM_014420.3 "*Homo sapiens* dickkopf WNT signaling pathway inhibitor 4 (DKK4), mRNA" Feb. 15, 2021, 4 pages.
GenBank Accession No. NM_014421.3 "*Homo sapiens* dickkopf WNT signaling pathway inhibitor 2 (DKK2), mRNA" Feb. 13, 2021, 4 pages.
GenBank Accession No. NM_015881.6 "*Homo sapiens* dickkopf WNT signaling pathway inhibitor 3 (DKK3), transcript variant 1, mRNA" Feb. 23, 2021, 5 pages.
GenBank Accession No. NP_004054.3 "cadherin-17 precursor [*Homo sapiens*]" May 25, 2022, 4 pages.
GenBank Accession No. NP_005805.1 "cell surface A33 antigen precursor [*Homo sapiens*]" Jun. 3, 2022, 4 pages.
GenBank Accession No. NP_036374.1 "dickkopf-related protein 1 precursor [*Homo sapiens*]" Mar. 3, 2021, 3 pages.
GenBank Accession No. NP_055236.1 "dickkopf-related protein 2 precursor [*Homo sapiens*]" Feb. 13, 2021, 3 pages.
GenBank Accession No. NP_149038.3 "mucin-13 precursor [*Homo sapiens*]" Oct. 17, 2021, 4 pages.
"GenVec Provides Investor Update: Highlights ongoing Initiatives Involving the AdenoVerse Gene Delivery Platform" GenVec Press Release, Jan. 20, 2016, 1 page.
"GenVec Provides Update on Hearing Loss Clinical Program: Data Safety Monitoring Board Recommends Trial Continue" GenVec Press Release, May 2, 2016, 1 page.
Getz, J.A., et al., "Protease-resistant Peptide Ligands From a Knottin Scaffold Library," ACS Chemical Biology, Aug. 19, 2011, vol. 6(8), pp. 837-844.
Ghossaini, S. N., et al. (2013) "Round window membrane permeability to golimumab in guinea pigs: a pilot study." The Laryngoscope 123(11):2840-2844.
Gibbs, S. et al. (1993) Molecular Characterization and Evolution of the SPRR Family of Keratinocyte Differentiation Markers Encoding Small Proline-Rich Proteins. Genomics, 16:630-637.
Giotti et al. (2019) "Assembly of a parts list of the human mitotic cell cycle machinery" Journal of Molecular Cell Biology, 11(8):703-718.
Glinka et al. (1998) "Dickkopf-1 is a member of a new family of secreted proteins and functions in head induction." Nature, 391(6665):357-362.
Golde, et al. (2013) "γ-Secretase inhibitors and modulators." Biochimica et Biophysica Acta (BBA)-Biomembranes, 1828(12):2898-2907.
Gong, S. et al. (2017) "Fabs-in-tandem immunoglobulin is a novel and versatile bispecific design for engaging multiple therapeutic targets" mAbs, 9(7): 1118-1128.
Gong, Y. et al. (2010) "Wnt Isoform-Specific Interactions with Coreceptor Specify Inhibition or Potentiation of Signaling by LRP6 Antibodies" PLoS One, 5(9):e12682, doi:10.1371/journal.pone.0012682; 17 pages.
Gougelet, A., et al. (2014) "T-cell factor 4 and β-catenin chromatin occupancies pattern zonal liver metabolism in mice." Hepatology, 59(6):2344-2357. https://doi.org/10.1002/hep.26924.
Gubbels et al. (2008) "Functional auditory hair cells produced in the mammalian cochlea by in utero gene transfer." Nature, 455(7212):537-541.
Gulati S. et al. Nat Commun 9 1996 (2018).
Guo, L. et al. (2016) WNT/β-catenin signaling regulates cigarette smoke-induced airway inflammation via the PPARd/p38 pathway. Lab Invest, 96:218-229.
Gurney et al. (2012) "Wnt pathway inhibition via the targeting of Frizzled receptors results in decreased growth and tumorigenicity of human tumors", PNAS, 11717-11722.

(56) References Cited

OTHER PUBLICATIONS

Haas, M. et al. (2019) DeltaN-Tp63 Mediates Wnt/β-Catenin-Induced Inhibition of Differentiation in Basal Stem Cells of Mucociliary Epithelia. Cell Reports, 28:3338-3352.
Habermann, A.C. et al. (Jul. 2020) Single-cell RNA sequencing reveals profibrotic roles of distinct epithelial and mesenchymal lineages in pulmonary fibrosis. Sci Adv, 6:eaba1972, 15 pages.
Haegebarth et al. (2009). "Wnt Signaling, Lgr5, and Stem Cells in the Intestine and Skin." The American Jounral of Pathology. vol. 174, No. 3, pp. 715-721.
Hao, H-X. et al. (May 10, 2012) "ZNRF3 promotes Wnt receptor turnover in an R-spondin-sensitive manner" Nature, 485(7397):195-200.
Hawkins et al. (1976) "Hearing Loss and Cochlear Pathology in Monkeys After Noise Exposure" Acta Oto-Laryngologica 81(3-6):337-343.
Head et al. (2013) "Activation of canonical Wnt/β-catenin signaling stimulates proliferation in neuromasts in the zebrafish posterior lateral line." Developmental Dynamics 242(7):832-846.
Henderson et al. (2010) "Inhibition of Wnt/β-catenin/CREB binding protein (CBP) signaling reverses pulmonary fibrosis". Proceedings of the National Academy of Sciences, 107(32): 14309-14314.
Hirata et al. (2013) "Dose-dependent roles for canonical Wnt signalling in de novo crypt formation and cell cycle properties of the colonic epithelium" Development and Stem Cells, 140:66-75.
Ho et al. (2006) "Cysteine-Rich Domains of Muc3 Intestinal Mucin Promote Cell Migration, Inhibit Apoptosis, and Accelerate Wound Healing" Gastroenterology, 131:1501-1517.
Hollnagel, et al. (1999) "Id genes are direct targets of bone morphogenetic protein induction in embryonic stem cells." Journal of Biological Chemistry 274(28):19838-19845.
Holmen et al., "Wnt-independent activation of p. catenin mediated by a Dkk1-Fz5 fusion protein", Biochem Biophys Res Commun., Mar. 11, 2005, p. 533-539, 328(2), Elsevier, Amsterdam, Netherlands.
Hu et al., (2018) "Long-Term Expansion of Functional Mouse and Human Hepatocytes as 3D Organoids." Cell, 175:1591-1606, e19. doi:10.1016/j.cell.2018.11.013.
Huch et al., (2013) "In vitro expansion of single Lgr5+ liver stem cells induced by Wnt-driven regeneration." Nature 494(7436):247-250.
International Preliminary Report on Patentability for International Patent Application No. PCT/US2018/066616, dated Jun. 23, 2020, 8 pages.
International Search Report and Written Opinion for International Patent Application No. PCT/US2018/066616, dated May 1, 2019, 12 pages.
Izumikawa et al. (2005). "Auditory Hair Cell Replacement and Hearing Improvement by Atohl Gene Therapy in Deaf Mammals." Nat Med., 11(3): 271-276.
Izumikawa et al. (2008) "Response of the flat cochlear epithelium to forced expression of Atoh1." Hearing Research, 240(1-2):52-56.
Jacques, B.E. et al. (2013) A dual function for canonical Wnt/β-catenin signaling in the developing mammalian cochlea. Development, 139:4395-4404. Erratum, Development 140:247.
Janda, C.Y. et al. (May 11, 2017) "Surrogate Wnt agonists that phenocopy canonical Wnt and β-catenin signaling" Nature, 545(7653):234-237. HHS Public Access Author Manuscript, 35 pages.
Janda et al. (2012) "Structural basis of Wnt recognition by Frizzled" Science; 337:59-64.
Jiang et al. (2016) "A chronic obstructive pulmonary disease susceptibility gene, FAM13A, regulates protein stability of β-catenin". American Journal of Respiratory and Critical Care Medicine, 194(2): 185-197.
Jiang, X. et al., (2015) "Dishevelled promotes Wnt receptor degradation through recruitment of ZNRF3/RNF43 E3 ubiquitin ligases." Molecular Cell, 58(3):522-533.
Jin, Y-R. and J.K. Yoon (Dec. 2012) "The R-spondin family of proteins: Emerging regulators of WNT signaling" Int J Biochem Cell Biol, 44(12):2278-2287, doi: 10.1016/j.biocel.2012.09.006.
Joiner, D.M. et al. (Jan. 2013) "LRP5 and LRP6 in development and disease" Trends in Endocronology and Metabolism, 24(1):31-39.
Kahn et al. "Can we safely target the WNT pathway?", Nature Reviews. Drug Discovery, vol. 13, No. 7, Jul. 1, 2014 (Jul. 1, 2014), pp. 513-532.
Katoh, M. et al. (Sep. 2017) "Molecular genetics and targeted therapy of WNT-related human diseases (Review)" Intl J Mol Med, 40(3):587-606.
Kawamoto et al. (2003). "Math1 gene transfer generates new cochlear hair cells in mature guinea pigs in vivo." Journal of Neuroscience. 23(11): 4395-400.
Ke et al. (2013) "Structure and function of Norrin in assembly and activation of a Frizzled 4-Lrp5/6 complex" Genes and Development 27(21):2305-2319; Supplement Material.
Kechai, et al. (2015) "Recent advances in local drug delivery to the inner ear." International journal of pharmaceutics, 494(1):83-101.
Kelley, M.W. (Oct. 2007) Has hair cell loss MET its match? Proc Natl Acad Sci USA, 104(42):16400-16401.
Kelly et al. (2012) "Contractility in type III cochlear fibrocytes is dependent on non-muscle myosin II and intercellular gap junctional coupling." Journal of the Association for Research in Otolaryngology, 13(4):473-484.
Kim, H.-T. et al. (Dec. 2019) WNT/RYK signaling restricts goblet cell differentiation during lung development and repair. Proc Natl Acad Sci USA, 116(51):25697-25706.
Kim, K. A. et al. (2005) "Mitogenic Influence of Human R-Spondin1 on the Intestinal Epithelium." Science, 309(5738):1256-1259. https://doi.org/10.1126/science.1112521.
Kim, T.H. et al. (2011). Blockade of the Wnt/β-Catenin Pathway Attenuates Bleomycin-Induced Pulmonary Fibrosis. Tohoku Journal of Experimental Medicine, 223:45-54.
Kim, Y. S. et al. (2010) "Intestinal Goblet Cells and Mucins in Health and Disease: Recent Insights and Progress" Current Gastroenterology Rep, 12:319-330.
Kinchen et al. (2018) "Structural remodeling of the human colonic mesenchyme in inflammatory bowel disease." Cell, 175(2):372-386.
King et al. (2011) Idiopathic pulmonary fibrosis:. The Lancet, 378(9807): 1949-1961.
Kipp, A., et al. (2007)."Activation of the glutathione peroxidase 2 (GPx2) promoter by β-catenin." Biological Chemistry, 388(10):1027-1033. https://doi.0rg/10.1515/BC.2007.137.
Kneidinger et al. (2011) "Activation of the WNT/β-catenin pathway attenuates experimental emphysema". American Journal of Respiratory and Critical Care Medicine, 183(6): 723-733.
Knight, M.N. and K. Hankenson (2014) "R-spondins: Novel matricellular regulators of the skeleton" Matrix Biology, 37:157-161.
Königshoff, M. et al. (May 2008) Functional Wnt Signaling Is Increased in Idiopathic Pulmonary Fibrosis. PLoS ONE, 3(5):e2142; doi:10.1371/journal.pone.0002142, 12 pages.
Kobayashi et al. (2020) "Persistence of a regeneration-associated, transitional alveolar epithelial cell state in pulmonary fibrosis". Nature Cell Biology, 22(8): 934-946.
Koenig "Mutational landscape of antibody variable domains reveals a switch modulating the interdomain conformational dynamics and antigen binding" PNAS E486-E495 (Year: 2017).
Koo, B.K. et al. (2012) "Tumour suppressor RNF43 is a stem-cell E3 ligase that induces endocytosis of Wnt receptors." Nature, 488:665-669.
Kraft et al. (2013) "Atoh1 induces auditory hair cell recovery in mice after ototoxic injury." The Laryngoscope, 123(4):992-999.
Krausova et al. (2014) "Wnt signaling in adult intestinal stem cells and cancer." Cellular Signalling, 26(3):570-579. https://doi.org/10.1016/j.cellsig.2013.11.032.
Kruis, W. et al. (2019) Budesonide Suppositories Are Effective and Safe for Treating Acute Ulcerative Proctitis. Clin Gastroenterol Hepatol, 17:98-106.
Krupnik, V.E. et al. (1999) "Functional and structural diversity of the human Dickkopf gene family" Gene, 238(2):301-313.

(56) References Cited

OTHER PUBLICATIONS

Kumagai, K. et al. (Dec. 2010) Up-regulation of EGF receptor and its ligands, AREG, EREG, and HB-EGF in oral lichen planus. Oral Surg Oral Med Oral Pathol Oral Radiol Endod, 110(6):748-754.

Kuo et al. (2015). "In Vivo Cochlear Hair Cell Generation and Survival by Coactivation of beta-Catenin and Atoh1." Journal of Neuroscience, vol. 35, No. 30, p. 10786-10798.

Kussie et al. (1994), "A single engineered amino acid substitution changes antibody fine specificity", The Journal of Immunology, 152(1): 146-152.

Kyritsis, N. et al. (2012) "Acute Inflammation Initiates the Regenerative Response in the Adult Zebrafish Brain." Science, 338(6112):1353-1356. https://doi.org/10.1126/science.1228773.

Lam et al. (2014) "Wnt coreceptor Lrp5 is a driver of idiopathic pulmonary fibrosis". American Journal of Respiratory and Critical Care Medicine, 190(2): 185-195.

Lebensohn et al. (2018) "R-spondins can potentiate WNT signaling without LGRs." Elife 7:e33126, 1-18 pages.

Lehrnbecher et al., "Variant Genotypes of the Low-Affinity Fc Receptors in Two Control Populations and a Review of Low-Affinity Fc Receptor Polymorphisms in Control and Disease Populations." Blood (Dec. 1999); 94(12): 4220-4232.

Lim, X, et al., (2013) "Interfollicular epidermal stem cells self-renew via autocrine Wnt signaling." Science, 342(6163):1226-1230.

Liu et al. (2012) "Age-dependent in vivo conversion of mouse cochlear pillar and Deiters' cells to immature hair cells by Atoh1 ectopic expression." Journal of Neuroscience. 32(19):6600-6610.

Liu et al. (2014) "In vivo generation of immature inner hair cells in neonatal mouse cochleae by ectopic Atoh1 expression." PloS one, 9(2):e89377, 12 pages.

Liu J et al, "A small-molecule agonist of the Wnt signaling pathway", Angewandte Chemie International Edition, Verlag Chemie, (Mar. 18, 2005), vol. 44, No. 13, doi:10.1002/ANIE.200462552, ISSN 1433-7851, pp. 1987-1990, XP002495891.

Mah, A.T. et al. (2016). Wnt pathway regulation of intestinal stem cells. Journal of Physiology, 594(17):4837-4847. https://doi.org/10.1113/JP271754.

Mahtouk, K. et al. (2005). Expression of EGF-family receptors and amphiregulin in multiple myeloma. Amphiregulin is a growth factor for myeloma cells. Oncogene, 24:3512-3524.

Mao, B. et al. (May 2001) LDL-receptor-related protein 6 is a receptor for Dickkopf proteins. Nature 411:321-325.

Mao, B. et al. (Jun. 2002) Kremen proteins are Dickkopf receptors that regulate Wnt/beta-catenin signalling. Nature, 417:664-667.

Markovic, M.A. and P.L. Brubaker (2019). The roles of glucagon-like peptide-2 and the intestinal epithelial insulin-like growth factor-1 receptor in regulating microvillus length. Scientific Reports, 9:13010, 13 pages.

McCann, K.L. et al. (2020). H/ACA snoRNA levels are regulated during stem cell differentiation. Nucleic Acids Research, 48(15):8686-8703. https://doi.org/10.1093/nar/gkaa612.

McLean et al. (2017). "Clonal Expansion of Lgr5-Positive Cells from Mammalian Cochlea and High-Purity Generation of Sensory Hair Cells." Cell Reports,vol. 18, No. 8, p. 1917-1929.

Meteoglu, I. et al. (2008) Id-I: Regulator of EGFR and VEGF and potential target for colorectal cancer therapy. J Exp Clin Cancer Res, 27:69, doi:10.1186/1756-9966-27-69; 7 pages.

Mikels et al., "Wnts as ligands: processing, secretion and reception", Oncogene, 2006, pp. 7461-7468, 25, Nature Publishing Group, London, United Kingdom.

Milstein, C. et al. (Oct. 6, 1983). "Hybrid Hybridomas and Their Use in Immunohistochemistry," Nature, vol. 305, pp. 537-539.

Minear Steven et al, "Wnt proteins promote bone regeneration.", Science Translational Medicine Apr. 28, 2010, (Apr. 28, 2010), vol. 2, No. 29, ISSN 1946-6242, p. 29ra30, XP055449646.

Mitchell et al (1989) "Alpha-smooth muscle actin in parenchymal cells of bleomycin-injured rat lung". Laboratory Investigation; A Journal of Technical Methods and Pathology, 60(5): 643-650.

Mizutari et al. (2014). "Spontaneous Recovery of Cochlear Fibrocytes After Severe Degeneration Caused by Acute Energy Failure." Frontiers in Phamcacology, vol. 5, No. 198, pp. 1-3.

Molenaar, M. et al. (Aug. 1996) XTcf-3 Transcription Factor Mediates beta-Catenin-Induced Axis Formation in Xenopus Embryos. Cell, 86:391-399.

Murthy et al. (2022) "Human distal lung maps and lineage hierarchies reveal a bipotent progenitor". Nature, 604(7904): 111-119.

Muyldermans, et al., "Nanobodies: Natural Single-Domain Antibodies," Annual Review of Biochemistry vol. 82:775-797 (Volume publication date Jun. 2013) First published online as a Review in Advance on Mar. 13, 2013 https://doi.org/10.1146/annurev-biochem-063011-092449.

Nabhan, A.N. et al. (Mar. 2018). A single cell Wnt signaling niches maintain sternness of alveolar type 2 cells. Science, 359(6380):1118-1123. HHS Public Access Author Manuscript, 28 pages.

Nishino, J. et al. (Oct. 2008) Hmga2 Promotes Neural Stem Cell Self-Renewal in Young but Not Old Mice by Reducing p16Ink4a and p19Arf Expression. Cell, 135(2):227-239. https://doi.org/10.1016/j.cell.2008.09.017.

Nusse, R. (2005) "Wnt signaling in disease and in development" Cell Research, 15(1):28-32.

Oesterle, E.C. et al. (2008) Sox2 and Jagged1 Expression in Normal and Drug-Damaged Adult Mouse Inner Ear. J Assoc Res Otolaryngol (JARO), 9(1):65-89.

Pan, S. et al. (Jun. 2013) Lentivirus carrying the Atoh1 gene infects normal rat cochlea. 8(17):1551-1559.

Parisi, S. et al. (2020). HMGA Proteins in Sternness and Differentiation of Embryonic and Adult Stem Cells. International Journal of Molecular Sciences, 21(1):362, 17 pages, https://doi.org/10.3390/ijms21010362.

Park, J-S. et al. (2014) Human AP Endonuclease 1: A Potential Marker for the Prediction of Environmental Carcinogenesis Risk. Oxidative Medicine and Cellular Longevity, 2014:730301, http://dx.doi.org/10.1155/2014/730301, 15 pages.

Park, S-W. et al. (Apr. 2009) The protein disulfide isomerase AGR2 is essential for production of intestinal mucus. PNAS USA, 106(17):6950-6955.

Pavlovic, Z. et al. (2018) A synthetic anti-Frizzled antibody engineered for broadened specificity exhibits enhanced anti-tumor properties. mAbs,10(8):1157-1167, DOI: 10.1080/19420862.2018.1515565.

Pinto, D. et al. (2003) Canonical Wnt signals are essential for homeostasis of the intestinal epithelium. Genes & Dev, 17:1709-1713.

Powell, A.E. et al. (Mar. 2012). The Pan-ErbB Negative Regulator Lrig1 Is an Intestinal Stem Cell Marker that Functions as a Tumor Suppressor. Cell, 149(1):146-158. https://doi.org/10.1016/j.cell.2012.02.042.

Rey Jean-Philippe et al., "Wnt Modulators in the Biotech Pipeline", Developmental Dynamics, Wiley-Liss, Inc., New York, NY, US, vol. 239, No. 1, doi:10.1002/DVDY.22182, ISSN 1058-8388, (Jan. 1, 2010), pp. 102-114, (Dec. 4, 2009), XP002694073.

Reyfman, P.A. et al. (Jun. 2019) Single-Cell Transcriptomic Analysis of Human Lung Provides Insights into the Pathobiology of Pulmonary Fibrosis. American Journal of Respiratory and Critical Care Medicine, 199(12):1517-1536.

Rock et al. (2011) "Multiple stromal populations contribute to pulmonary fibrosis without evidence for epithelial to mesenchymal transition". Proceedings of the National Academy of Sciences, 108(52): E1475-E1483.

Ruzinova, M.B. and R. Benezra (Aug. 2003) Id proteins in development, cell cycle and cancer. TRENDS Cell Biol, 13(8):410-418.

Safdari Y., et al., "Antibody Humanization Methods—A Review and Update," Biotechnology and Genetic Engineering Reviews, Aug. 2013, vol. 29, No. 2, pp. 175-186.

Santos, A.J.M. et al. (Dec. 2018) The Intestinal Stem Cell Niche: Homeostasis and Adaptations. Trends in Cell Biol, 28(12):1062-1078, https://doi.org/10.1016/j.tcb.2018.08.001.

Sato et al. (2011). "Long-term expansion of epithelial organoids from human colon, adenoma, adenocarcinoma, and Barrett's epithelium," Gastroenterology, 141: 1762-1772.

(56) References Cited

OTHER PUBLICATIONS

Sato, T. et al. (May 14, 2009) "Single Lgr5 stem cells build crypt-villus structures in vitro without a mesenchymal niche" Nature, 459:262-265, www.nature.com/doifinder/10.1038/nature07935; with "Methods", 1 page.

Schaefer, W. et al. (Jul. 2011) Immunoglobulin domain crossover as a generic approach for the produciton of bispecific IgG antibodies. Proc Natl Acad Sci USA, 108(27):11187-11192.

Schmid, A. et al. (2017) Modulation of Wnt signaling is essential for the differentiation of ciliated epithelial cells in human airways. FEBS Lett, 591:3493-3506.

Schuijers et al. (2012) Adult mammalian stem cells: the role of Wnt, Lgr5 and R-spondins. EMBO J, 31:2685-2696.

Schutgens, F. et al. (Mar. 2019) Tubuloids derived from human adult kidney and urine for personalized disease modeling. Nat Biotechnol, 37(3):303-313; doi: 10.1038/S41587-019-0048-8. Epub Mar. 4, 2019. PMID: 30833775.

Schwitalla, S. et al. (Jan. 2013) Intestinal Tumorigenesis Initiated by Dedifferentiation and Acquisition of Stem-Cell-like Properties. Cell, 152(1-2):25-38; https://doi.org/10.1016/j.cell.2012.12.012.

ScienceDaily (Aug. 27, 2019) "Researchers engineer antibodies that unlock body's regenerative potential" University of Toronto—Leslie Dan Faculty of Pharmacy [online], Retrieved Mar. 28, 2021 from: www.sciencedaily.com/releases/2019/08/190827084747.htm, 3 pages.

Sebastian et al. (2017) "Wnt co-receptors Lrp5 and Lrp6 differentially mediate Wnt3a signaling in osteoblasts" PLoS One 12:11 1-19.

Semenov, M.V. et al. (2001) Head inducer Dickkopf-1 is a ligand for Wnt coreceptor LRP6. Curr Biol, 11:951-961.

Shi, F. et al. (Jul. 2012) Wnt-Responsive Lgr5-Expresesing Stem Cells Are Hair Cell Progenitors in the Cochlea. J Neurosci, 32(28):9639-9648.

Shi, J. et al. (2017). Distinct Roles of Wnt/ β-Catenin Signaling in the Pathogenesis of Chronic Obstructive Pulmonary Disease and Idiopathic Pulmonary Fibrosis. Mediators of Inflammation, vol. 2017, Article ID 3520581, 16 pages.

Shi, S.Y., et al., "A biparatopic agonistic antibody that mimics fibroblast growth factor 21 ligand activity" Journal of Biological Chemistry (2018) 293(16):5909-5919.

Similie, B. et al. (Jul. 2019). Intra- and Inter-cellular Rewiring of the Human Colon during Ulcerative Colitis. Cell, 178(3):714-730; https://doi.org/10.1016/j.cell.2019.06.029.

Skronska-Wasek, W. et al. (Jul. 2017). Reduced Frizzled Receptor 4 Expression Prevents WNT/β-Catenin-driven Alveolar Lung Repair in Chronic Obstructive Pulmonary Disease. American Journal of Respiratory and Critical Care Medicine, 196(2):172-185.

Spanjer et al. (2016) "TGF-β-induced profibrotic signaling is regulated in part by the WNT receptor Frizzled-8". The FASEB Journal, 30(5): 1823-1835.

Spiess, C. et al., "Alternative molecular formats and therapeutic applications for bispecific antibodies," Molecular Immunology, Oct. 2015, 67:95-106.

Staerz, U.D. et al. Apr. 1985) Hybrid antibodies can target sites for attack by T cells. Nature, 314(6012):628-631.

Steinhart, Z. et al. (Jan. 2017) "Genome-wide CRISPR screens reveal a Wnt-FZD5 signaling circuit as a druggable vulnerability of RNF43-mutant pancreatic tumors" Nat Med, 23(1):60-68.

Strunz, M. et al. (2020). Alveolar regeneration through a Krt8+ transitional stem cell state that persists in human lung fibrosis. Nat Commun, 11:3559; https://doi.org/10.1038/s41467-020-17358-3, 20 pages.

Svensson, F. et al. (2018). The central exons of the human MUC2 and MUC6 mucins are highly repetitive and variable inn sequence between individuals. Scientific Reports, 8:17503, DOI:10.1038/S41598-015-35499-w; 10 pages.

Takahashi et al. (2020). Stem Cell Signaling Pathways in the Small Intestine. Int J Mol Sci, 21:2032, doi:10.3390/ijms21062032; 18 pages.

Tao, Y. et al. (2019) "Tailored tetravalent antibodies potently and specifically activate Wnt/Frizzled pathways in cells, organoids and mice" eLife, 8:046134, DOI: https://doi.org/10.7554/eLife.46134, 16 pages.

Tian, H. et al. (Oct. 2011) A reserve stem cell population in small intestine renders Lgr5-positive cells dispensable. Nature, 478:255-259, with Methods, 1 page; Corrigendum, 482:120 (Feb. 2012).

Tomita, H. et al. (2016) Aldehyde dehydrogenase 1A1 in stem cells and cancer. Oncotarget, 7(10):11018-11032.

Tu, S. et al. (2018) The role of Foxq1 in proliferation of human dental pulp stem cell. Biochem Biophys Res Commun, 497:543-549.

Ulsamer, A. et al. (Feb. 2012) Axin Pathway Activity Regulates in Vivo pY654-β-catenin Accumulation and Pulmonary Fibrosis. J Biol Chem, 287(7):5164-5172.

U.S. Appl. No. 62/641,217, filed Mar. 9, 2018.
U.S. Appl. No. 62/680,508, filed Jun. 4, 2018.
U.S. Appl. No. 62/680,515, filed Jun. 4, 2018.
U.S. Appl. No. 62/680,522, filed Jun. 4, 2018.

Van Der Post, S. et al. (2019) Structural weakening of the colonic mucus barrier is an early event in ulcerative colitis pathogenesis. 68:2142-2151.

Vincke, C. and S. Muyldermans (2012) "Introduction to heavy chain antibodies and derived Nanobodies" Methods Mol Biol, 911:15-26, doi: 10.1007/978-1-61779-968-6_2.

Vincke, C. et al., "General strategy to humanize a camelid single-domain antibody and identification of a universal humanized nanobody scaffold", J Biol Chem. (2009); 284(5):3273-3284.

Wang, R. et al. (2011) Down-Regulation of the Canonical Wnt β-Catenin Pathway in the Airway Epithelium of Healthy Smokers and Smokers with COPD. PLoS ONE, 6(4):e14793; doi:10.1371/journal.pone.0014793.

Wang, T. et al. (Apr. 2015) Lgr5+ cells regenerate hair cells via proliferation and direct transdifferentiation in damaged neonatal mouse utricle. Nat Commun, 6:6613; DOI: 10.1038/ncomms7613, 15 pages.

Wang, X. et al. (2015) Blocking the Wnt/β-Catenin Pathway by Lentivirus-Mediated Short Hairpin RNA Targeting β-Catenin Gene Suppresses Silica-Induced Lung Fibrosis in Mice. Int J Environ Res Public Health, 12:10739-10754.

Wang, X. et al. (2018) IgG Fc engineering to modulate antibody effector functions. Protein Cell, 9:63-73.

Wang, Z. et al. (2019) Wnt Signaling in vascular eye diseases. Prog Retin Eye Res, 70:110-133.

Wehkamp, J. et al. (2007) "The Paneth cell alpha-defensin deficiency of ileal Crohn's disease is linked to Wnt/Tcf-4" J Immunol, 179:3109-3118.

Whyte "Wnt signaling and injury repair" Cold Spring Harb Perspect Biol 2012;4:a008078 (Year: 2012).

Wirtz, S. et al. (2017). Chemically induced mouse models of acute and chronic intestinal inflammation. Nature Protocols, 12(7), 1295-1309. https://doi.org/10.1038/nprot.2017.044.

Wong et al. (2015). "Mechanisms of sensorineural cell damage, death and survival in the cochlea." Frontiers in Aging Neuroscience. vol. 7, Article 58, pp. 1-15.

Wu, C. et al. "Simultaneous targeting of multiple disease mediators by a dual-variable-domain immunoglobulin", Nat Biotechnol. Nov. 2007;25(11):1290-7.

Wu et al. (2013). "In vivo delivery of Atoh1 gene to rat cochlea using a dendrimer-based nanocarrier." Journal of biomedical nanotechnology. 9(10): 1736-45.

Xie, Y. et al. (Oct. 2013) "Interaction with both ZNRF3 and LGR4 is required for the signalling activity of R-spondin" EMBO Reports, 14(12):1120-1126.

Xu et al. (2016) "Single-cell RNA sequencing identifies diverse roles of epithelial cells in idiopathic pulmonary fibrosis". JCI Insight, 1(20): 1-19.

Yan, K.S. et al. (May 2017). Non-equivalence of Wnt and R-spondin ligands during Lgr5+ intestinal stem-cell self-renewal. Nature, 545(7653):238-242. doi:10.1038/nature22313; HHS Public Access Author Manuscript, 36 pages.

(56) References Cited

OTHER PUBLICATIONS

Zacharias et al. (2018) "Regeneration of the lung alveolus by an evolutionarily conserved epithelial progenitor". Nature, 555(7695): 251-255.

Zapata, G. et al. (1995) Engineering linear F(ab')2 fragments for efficient production in *Escherichia coli* and enhanced antiproferative activity. Protein Eng. 8( 10): 1057-1062.

Zatorski, H. et al. (2019) Role of glucagon-like peptides in inflammatory bowel diseases-current knowledge and future perspectives. Nauryn-Schmiedeberg's Archives of Pharmacology, 392:1321-1330.

Zepp et al. (2017) "Distinct mesenchymal lineages and niches promote epithelial self-renewal and myofibrogenesis in the lung". Cell, 170(6): 1134-1148.

Zhang et al. (2014) "3D structural fluctuation of IgG1 antibody revealed by individual particle electron tomography" Scientific Reports 5:09803 1-13.

Zhang, M. et al. (Mar. 2020) Targeting the Wnt signaling pathway through R-spondin 3 identifies an anti-fibrosis treatment strategy for multiple organs. PLoS ONE, 15(3):e0229445.

Zhang, S. et al. (Jul. 2019) Frizzled-9+ Supporting Cells Are Progenitors for the Generation of Hair Cells in the Postnatal Mouse Cochlea. Front Mol Neurosci, 12:184, doi:10.3389/fnmol.2019.00184, 11 pages.

Zhang, T. et al. (2018) Overexpression of FOXQ1 enhances anti-senescence and migration effects of human umbilical cord mesenchymal stem cells in vitro and in vivo. Cell and Tissue Research, 373:379-393.

Zhao, J. et al. (2007). R-spondin1, A Novel Intestinotrophic Mitogen, Ameliorates Experimental Colitis in Mice. Gastroenterology, 132(4):1331-1343. https://doi.org/10.1053/j.gastro.2007.02.001.

Zheng, W. et al. (2006) Evaluation of AGR2 and AGR3 as cadidate genes for inflammatory bowel disease. Genes and Immunity, 7:11-18.

Zhou, B. et al. (Nov. 2020) The angiocrine Rspondin3 instructs interstitial macrophage transition via metabolic-epigenetic reprogramming and resolves inflammatory injury. Nat Immunol, 21:1430-1443, with Methods, 14 pages.

Rong, Chen (2016) "Research progress of Wnt/ β-Catenin signaling pathwy-specific molecular targeted drugs". J. Mod. Med. Health, 32(5):700-702, with Google Translation. doi: 10.3969/j.issn.1009-5519. May 22, 2016.

Xiao, Sa, et al., "Establishment of long-term serum-free culture for lacrimal gland stem cells aiming at lacrimal gland repair," Stem Cell Research & Therapy, (Jan. 8, 2020), 11:20, 13 pages.

\* cited by examiner

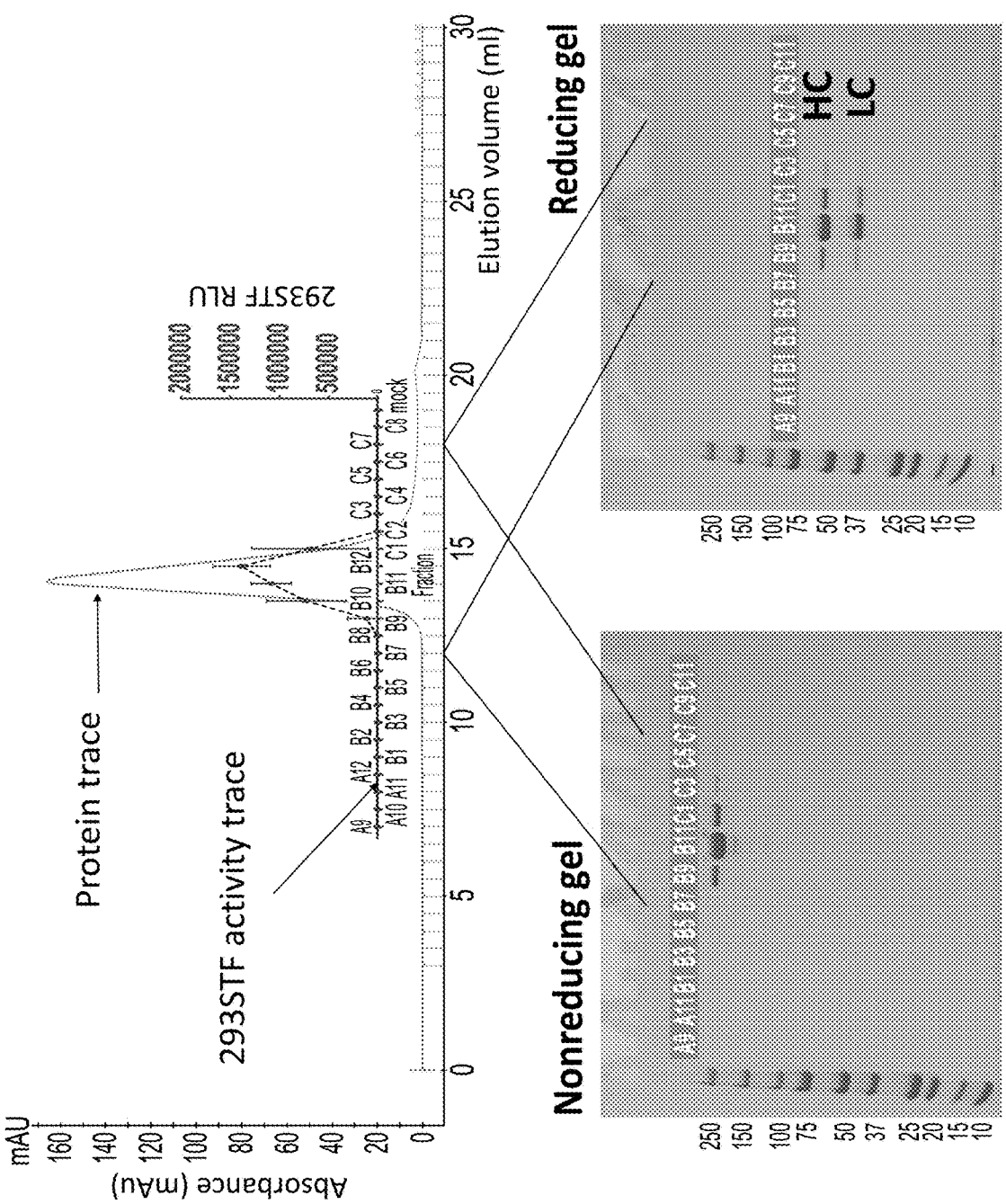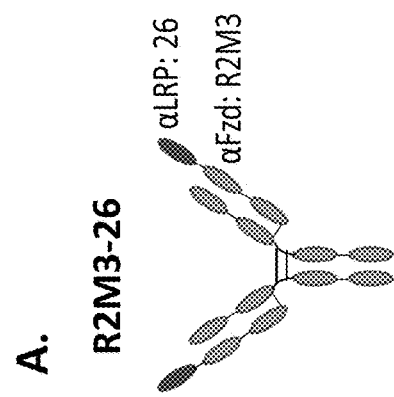
FIG. 2

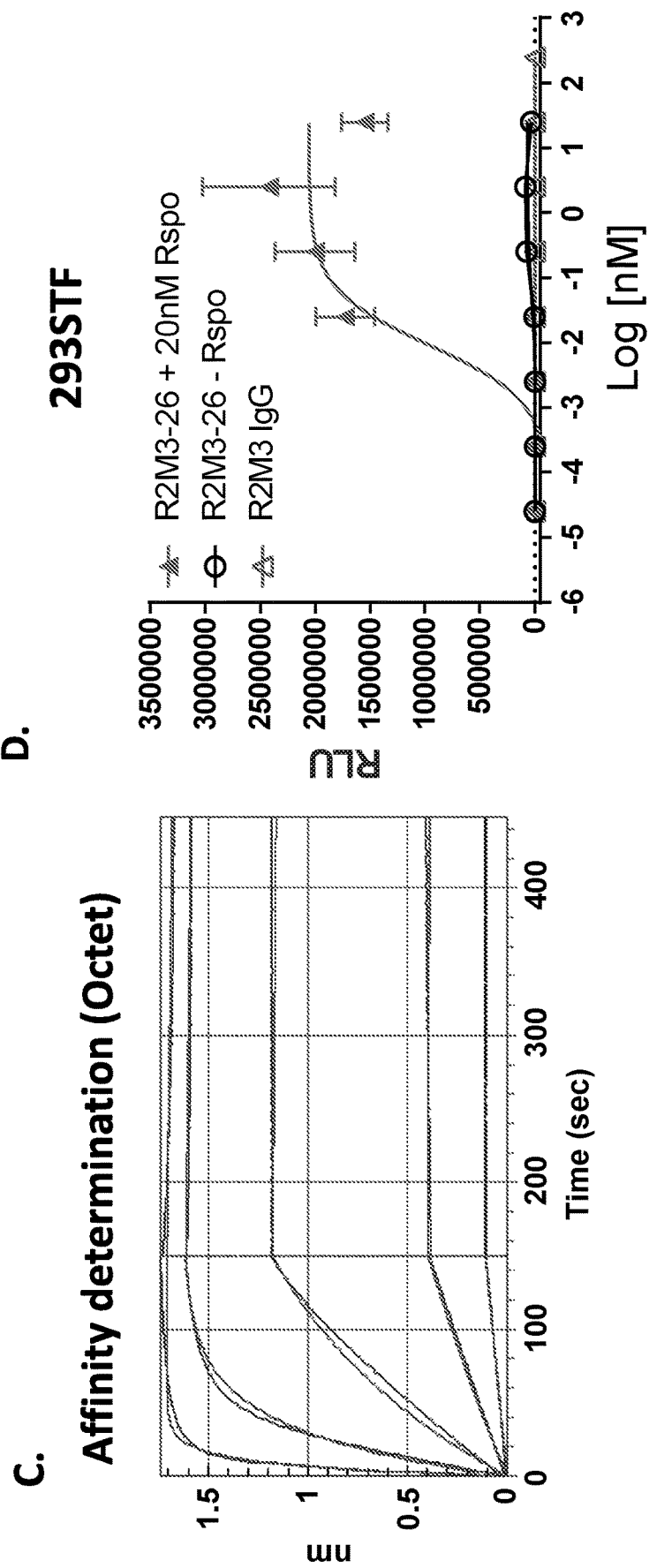
FIG. 2 (contd.)

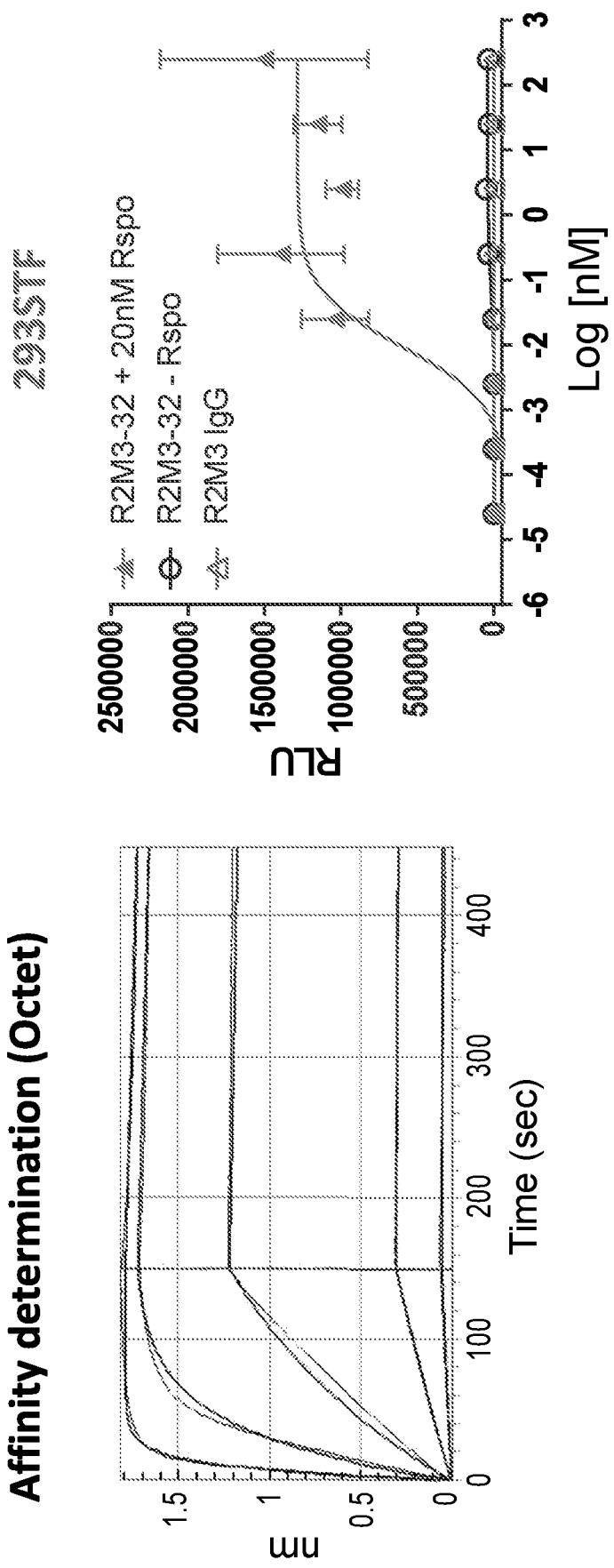
FIG. 3 (contd.)

A.
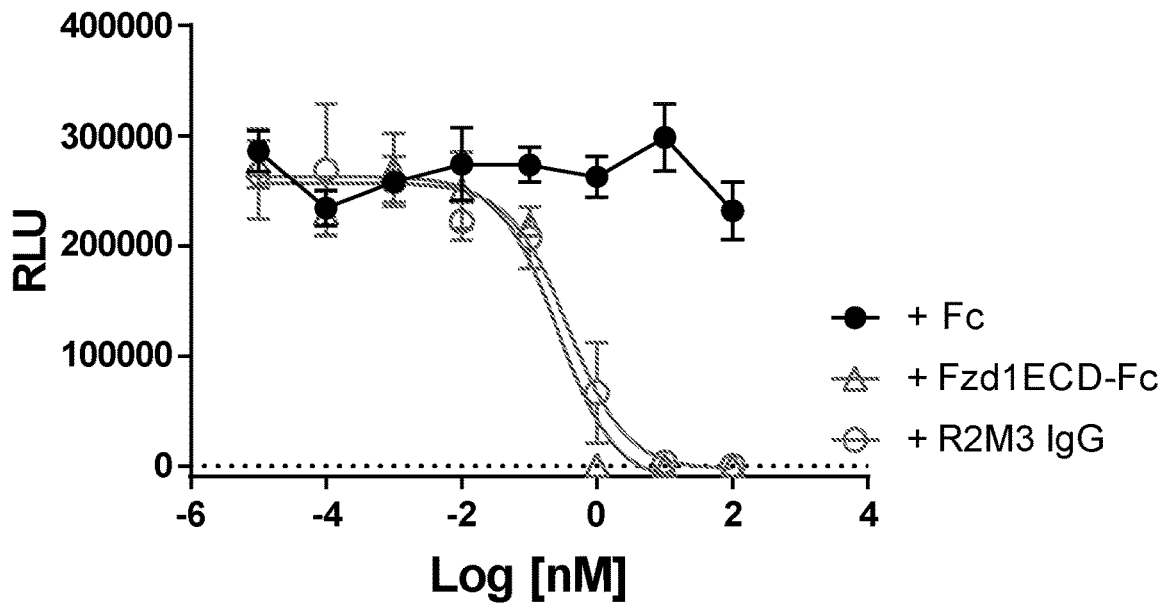
B.
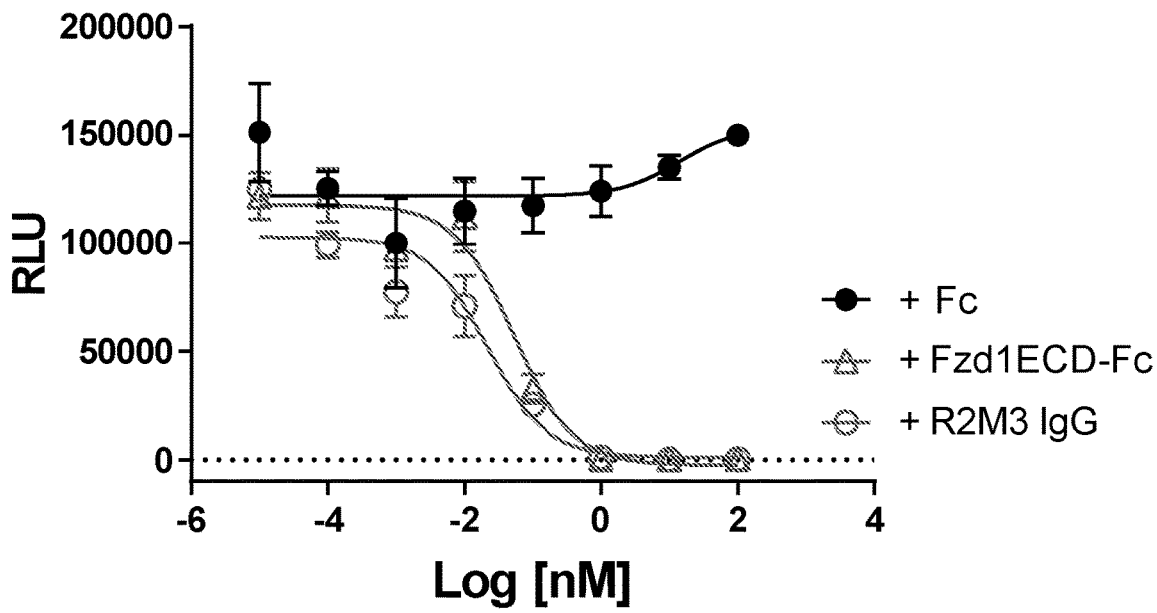
FIG. 4

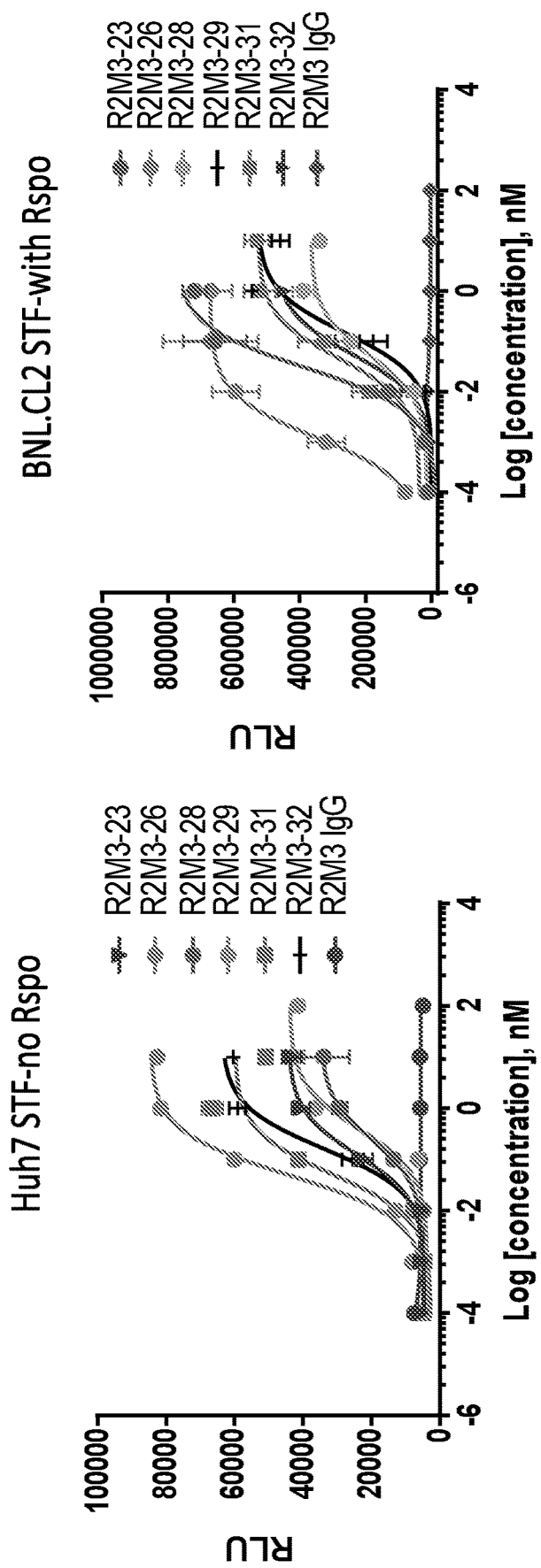
FIG. 5 (contd.)

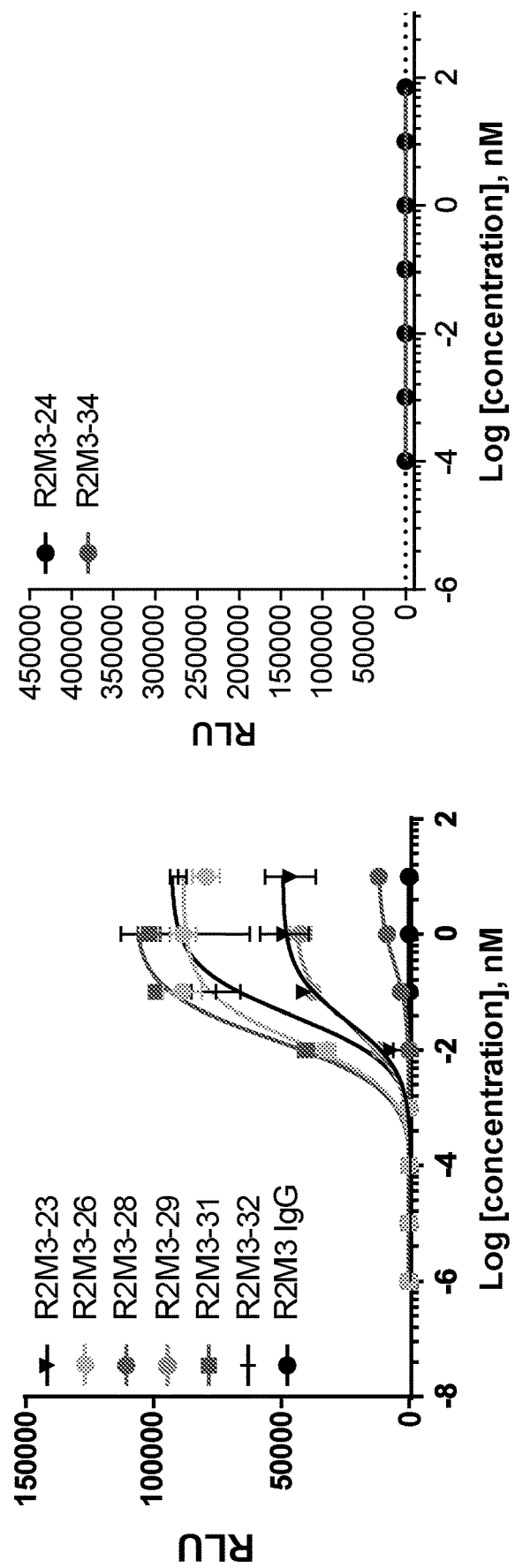
FIG. 5 (contd.)

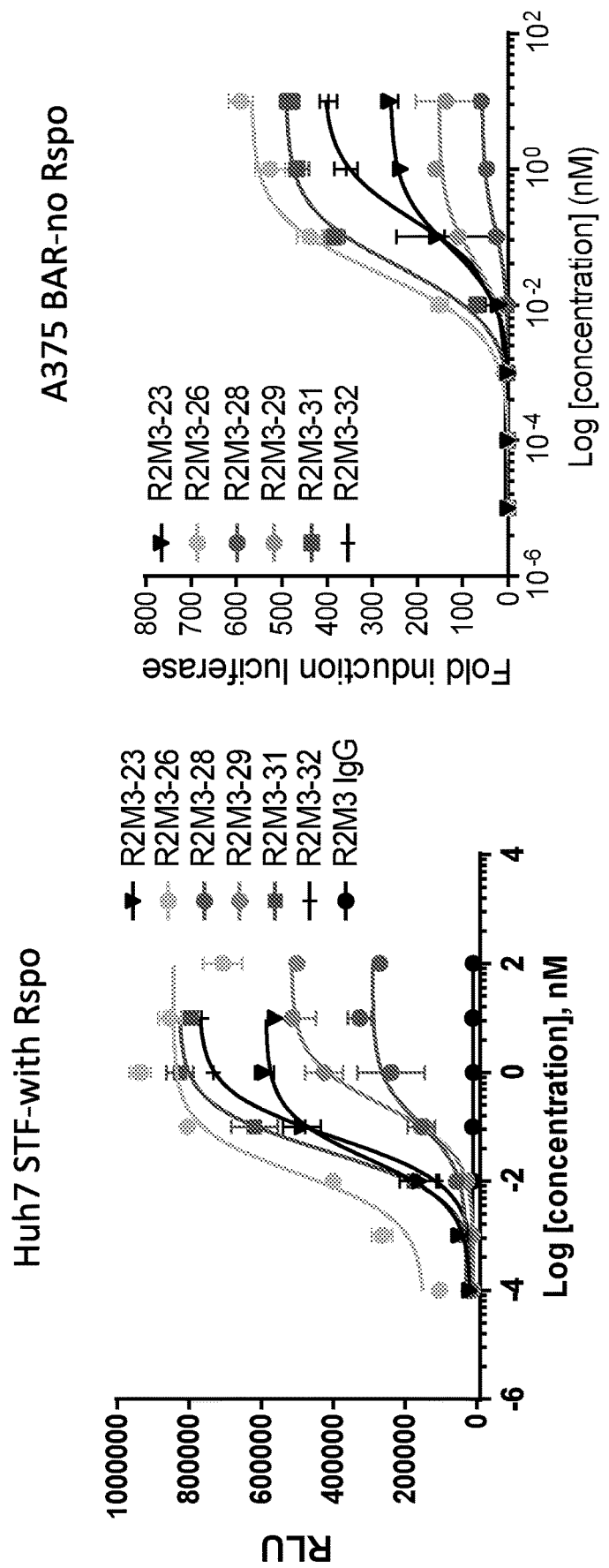
FIG. 5 (contd.)

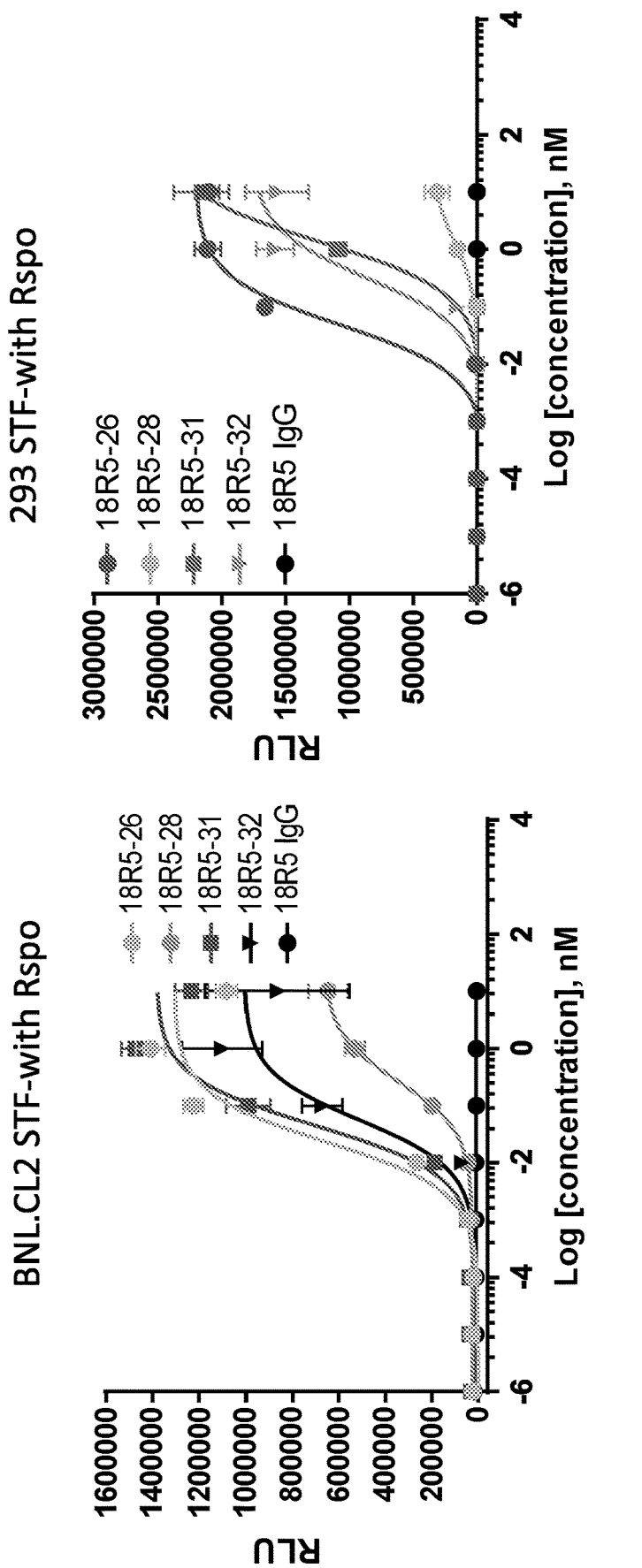
FIG. 6 (contd.)

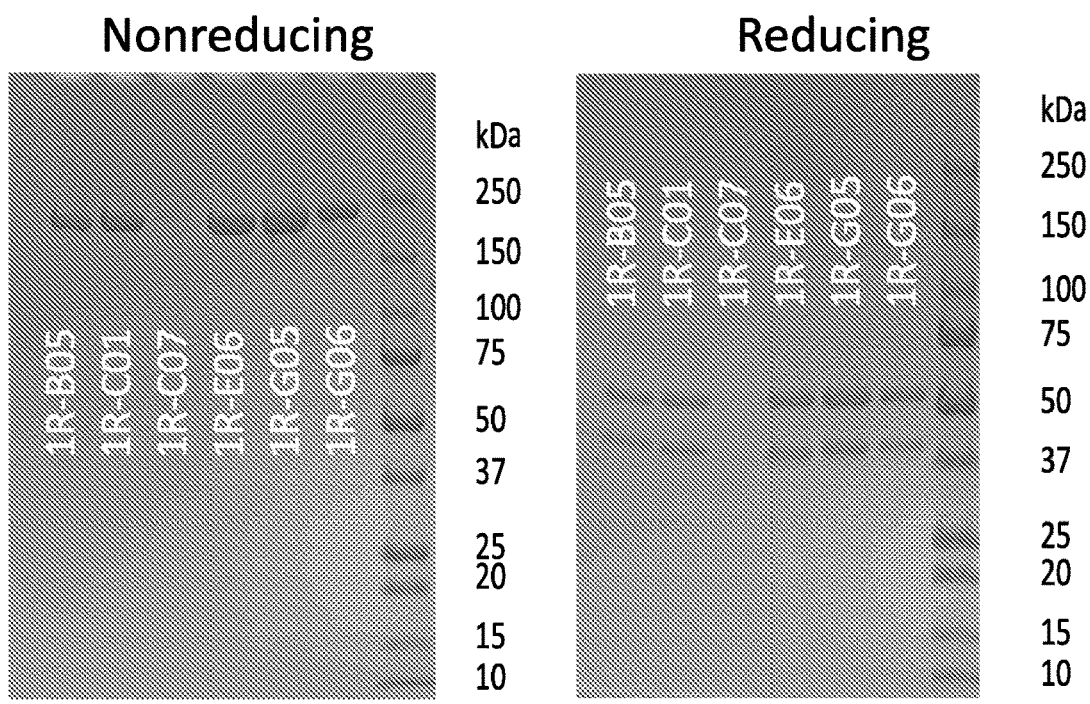
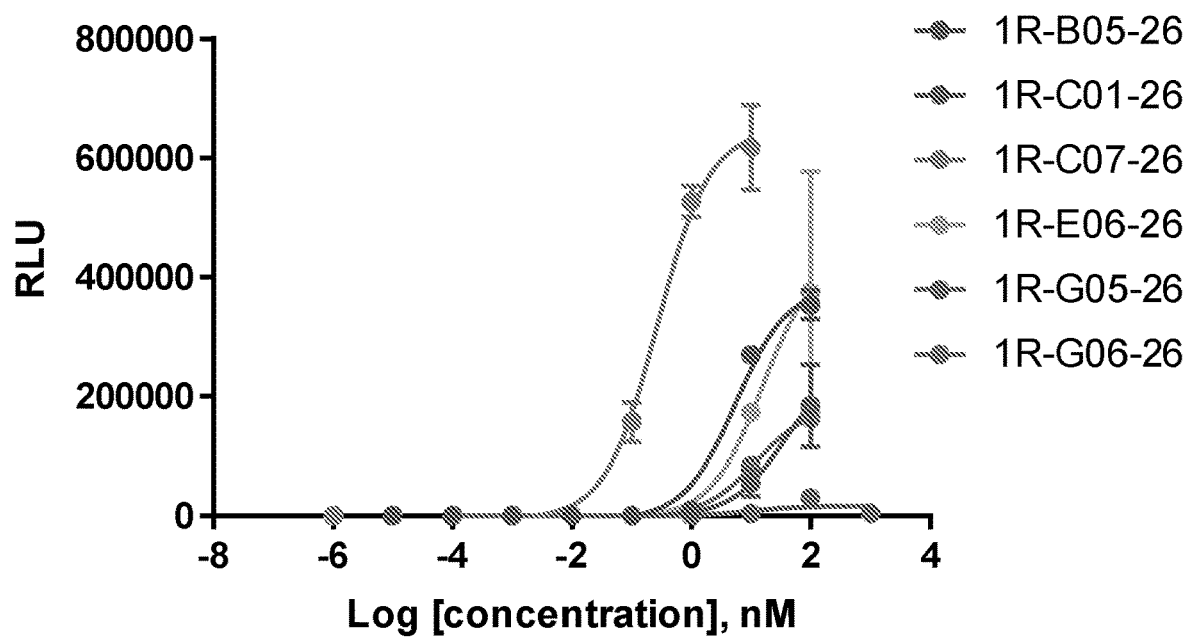
FIG. 8

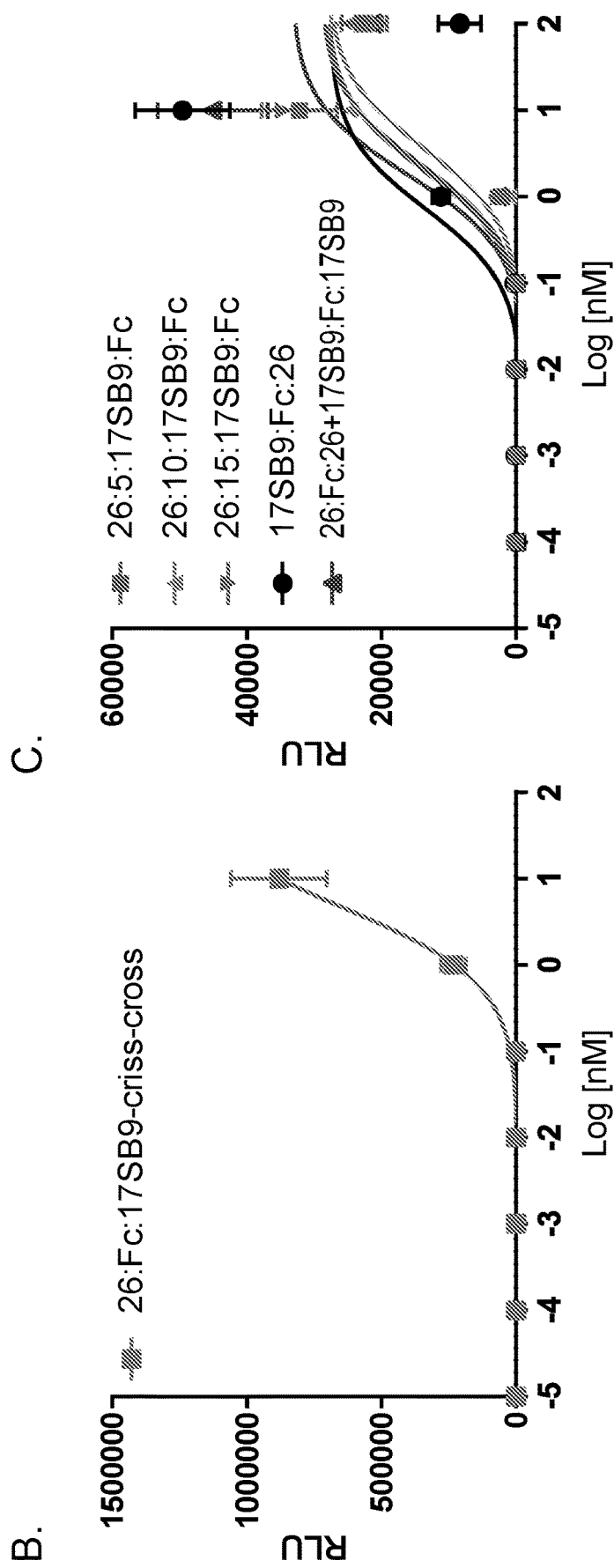
FIG. 13 (contd.)

D.

26:Fc:17SB9-criss-cross

αLRP: 26 — αFzd: 17SB9
αFzd: 17SB9 — αLRP: 26

26:5:17SB9:Fc
26:10:17SB9:Fc
26:15:17SB9:Fc

αLRP: 26 — αLRP: 26
αFzd: 17SB9

26:Fc:17SB9

αLRP: 26 — αLRP: 26
αFzd: 17SB9 — αFzd: 17SB9

26:Fc:26+17SB9:Fc:17SB9

αLRP: 26 — αFzd: 17SB9
αLRP: 26 — αFzd: 17SB9

17SB9:Fc:26

αFzd: 17SB9 — αFzd: 17SB9
αLRP: 26 — αLRP: 26

FIG. 13 (contd.)

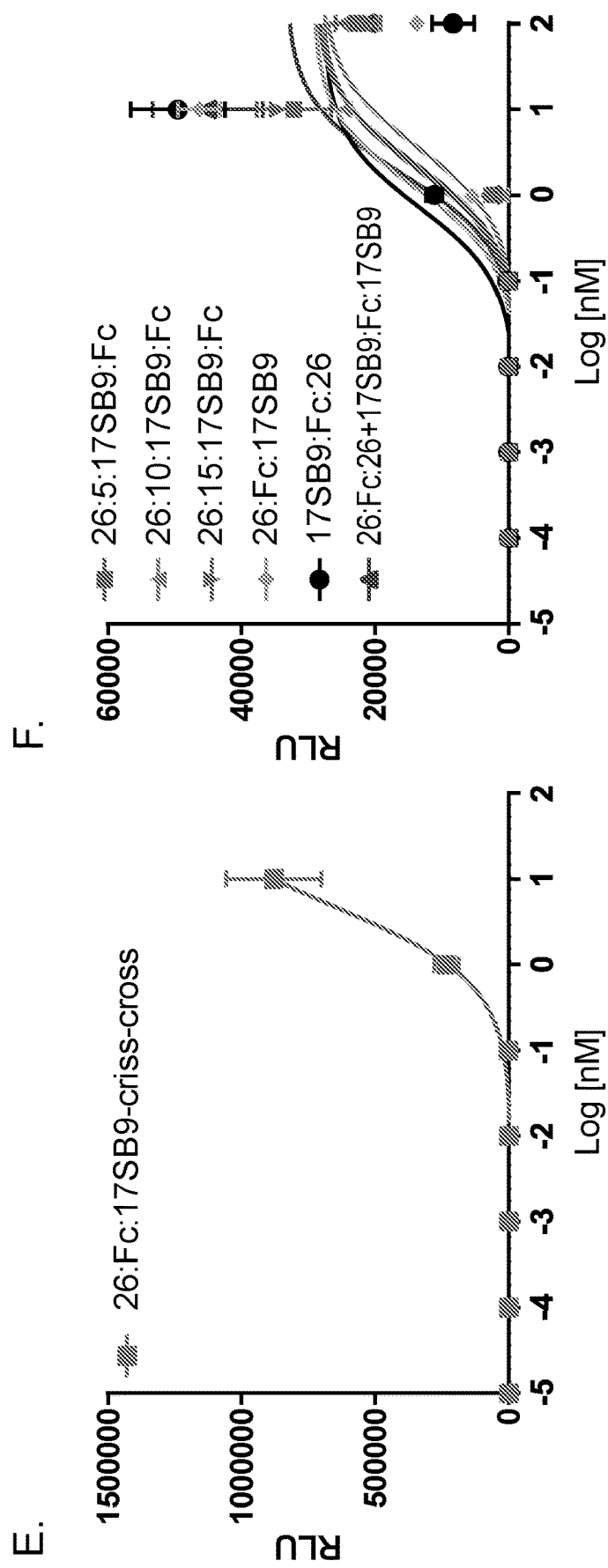
FIG. 13 (contd.)

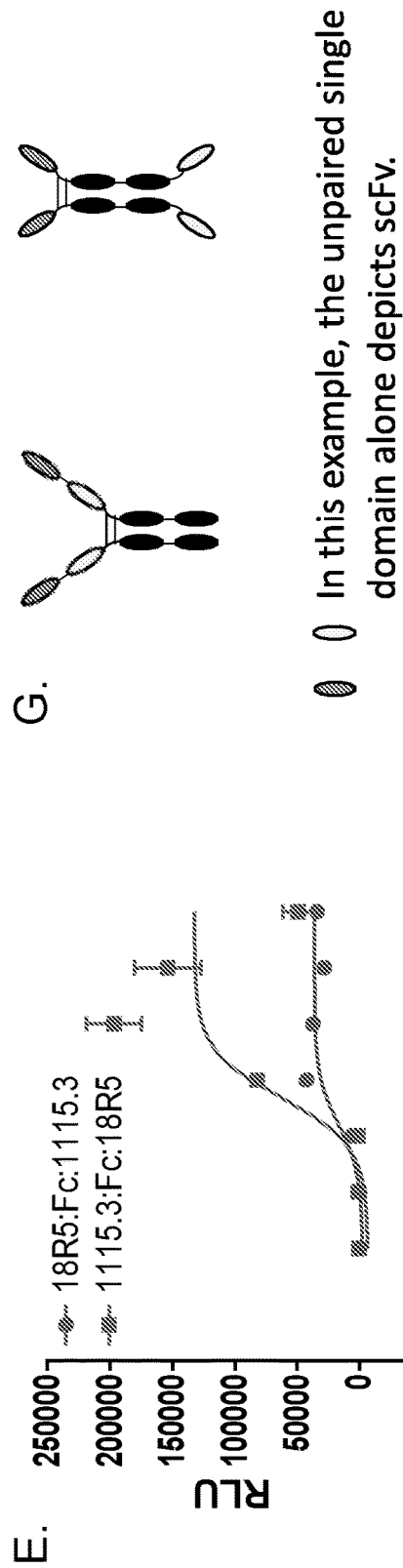
FIG. 14 (contd.)

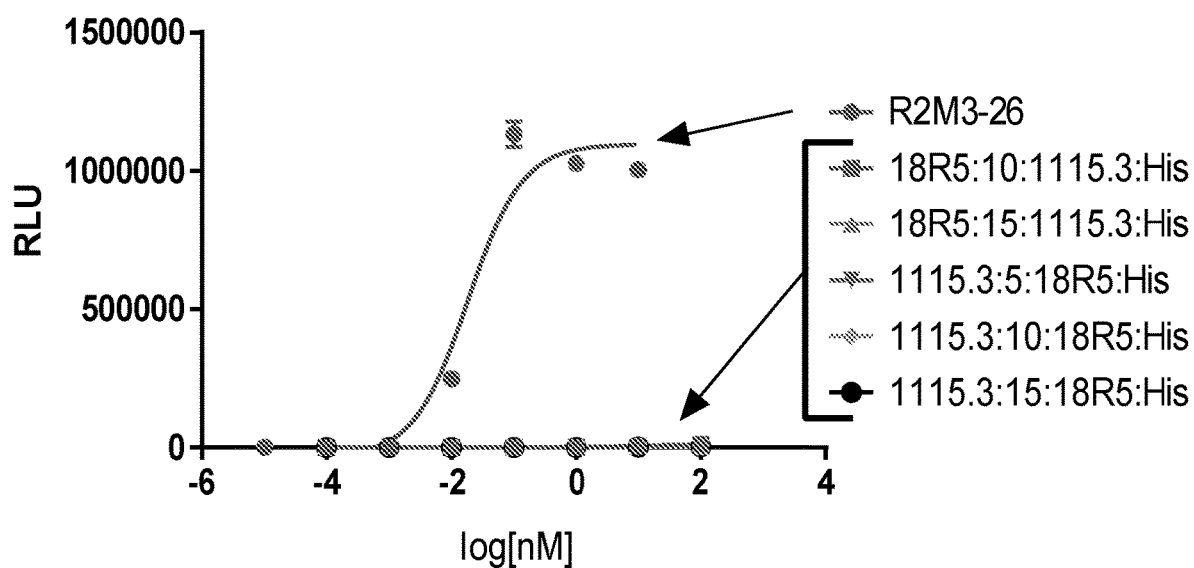
FIG. 14 (contd.)

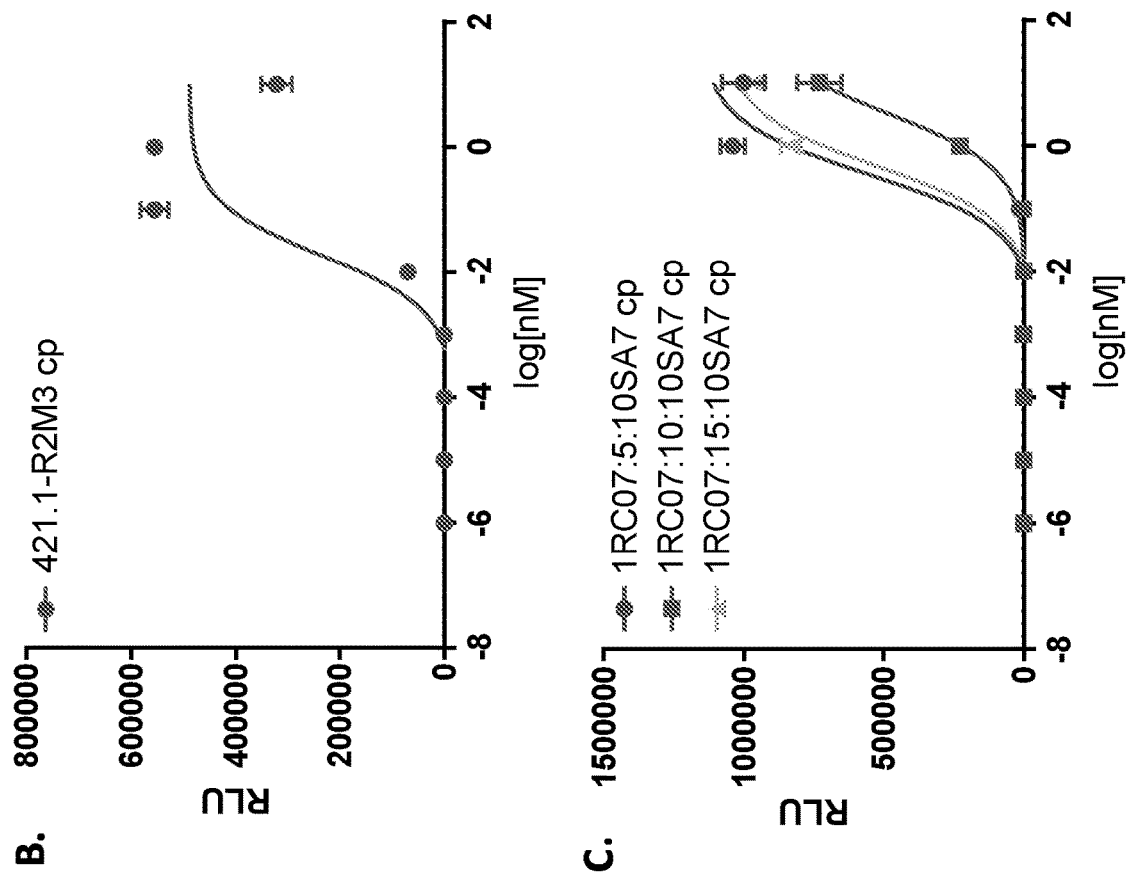
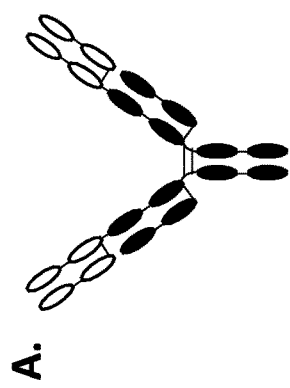
FIG. 15

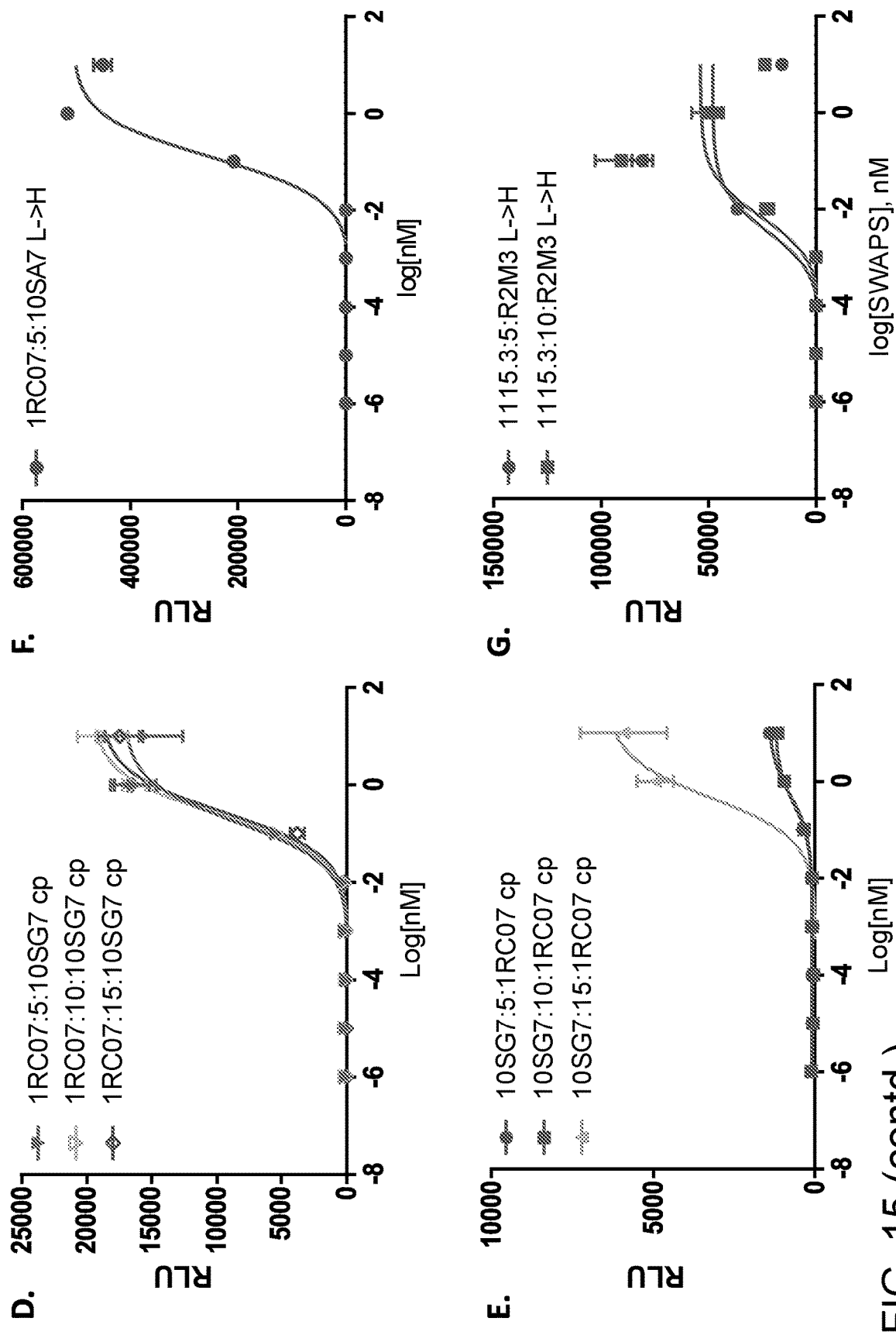
FIG. 15 (contd.)

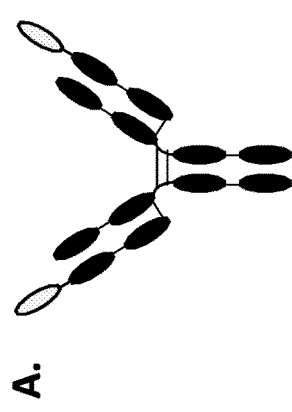
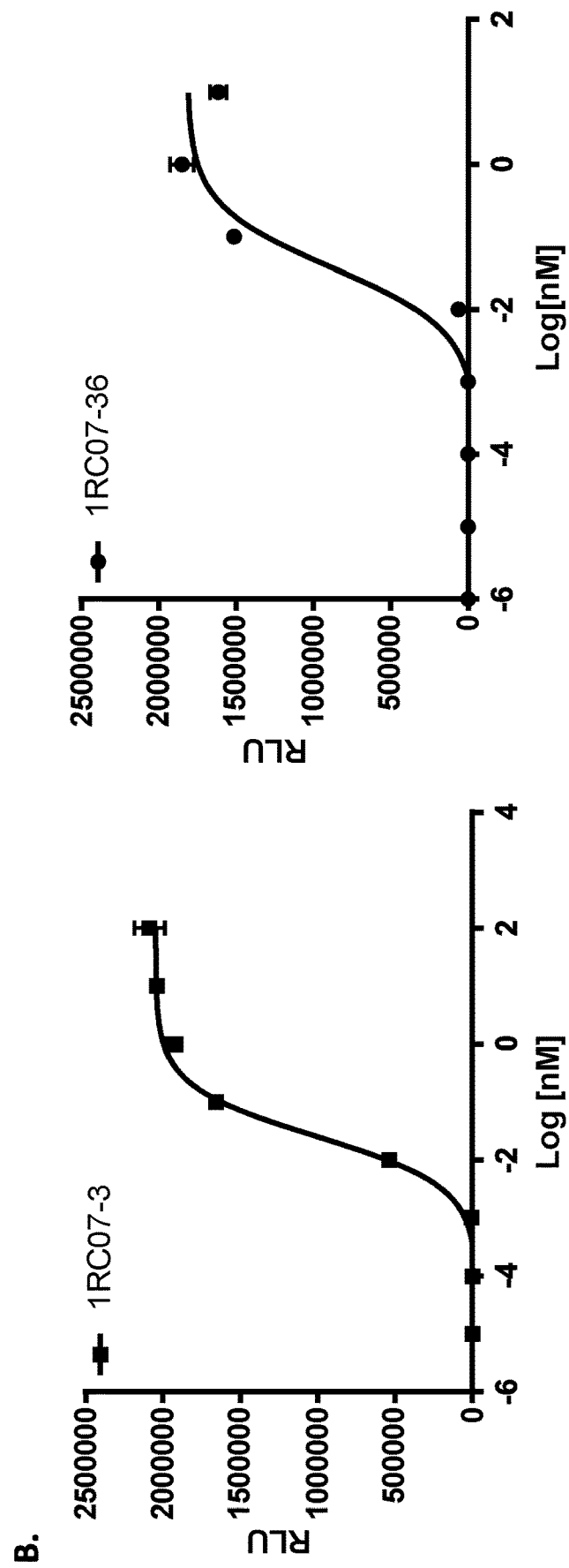
FIG. 17

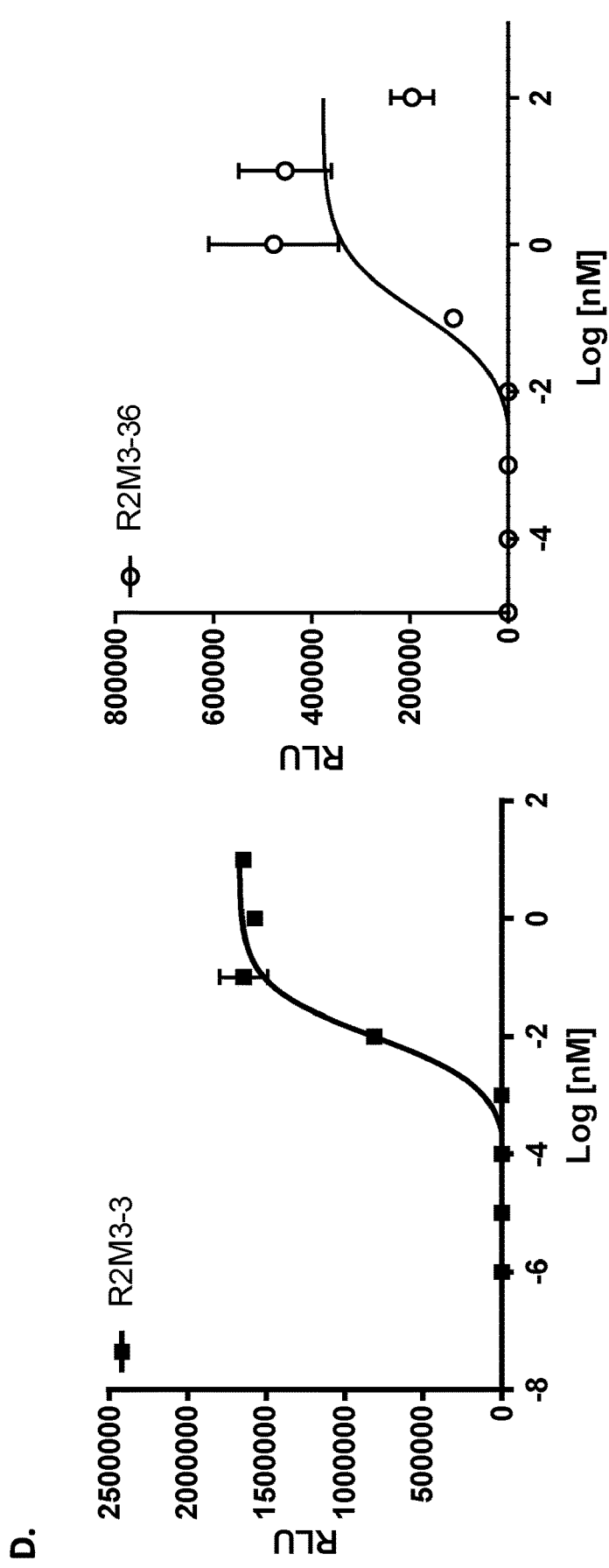
FIG. 17 (contd.)

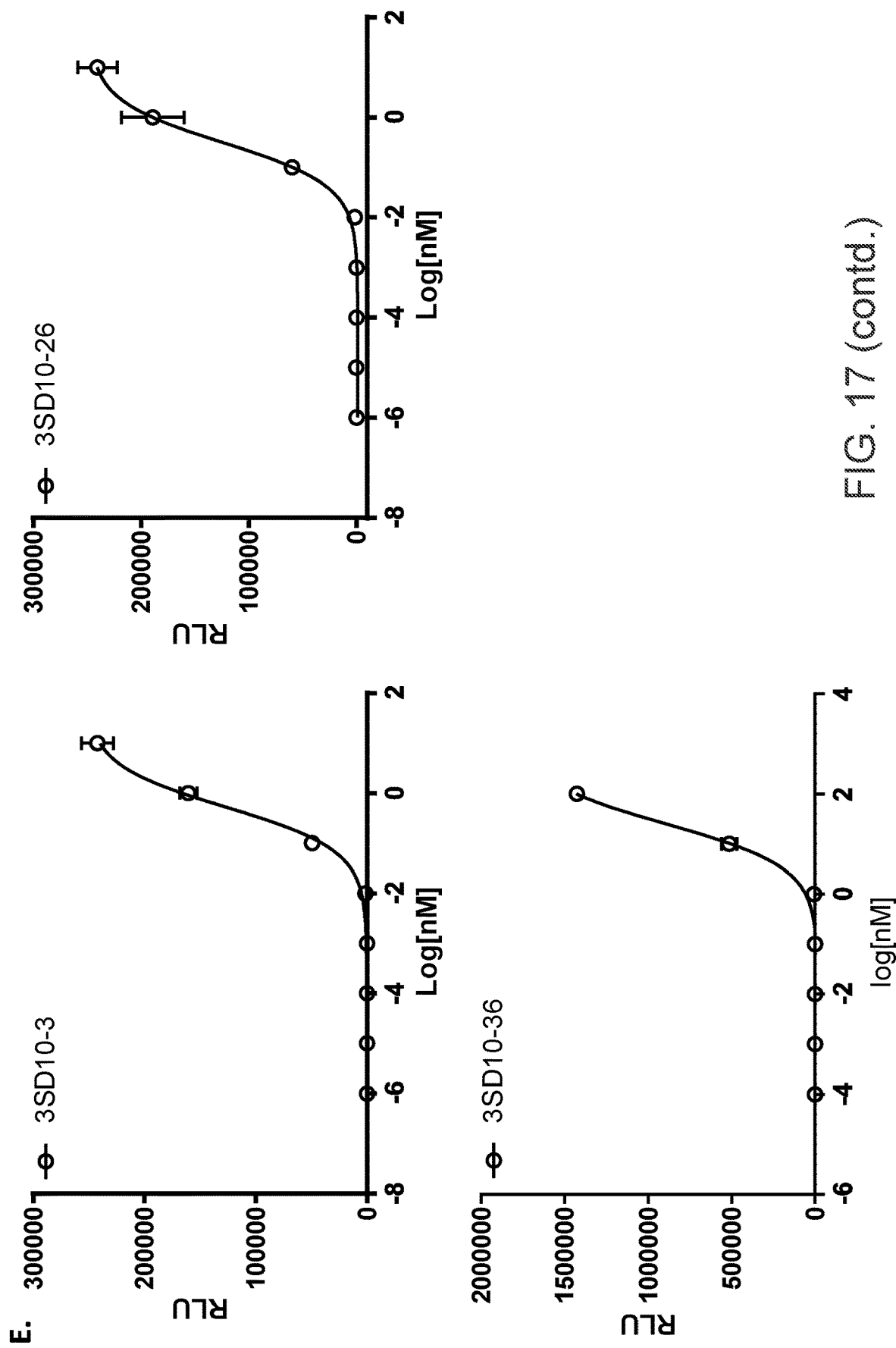
FIG. 17 (contd.)

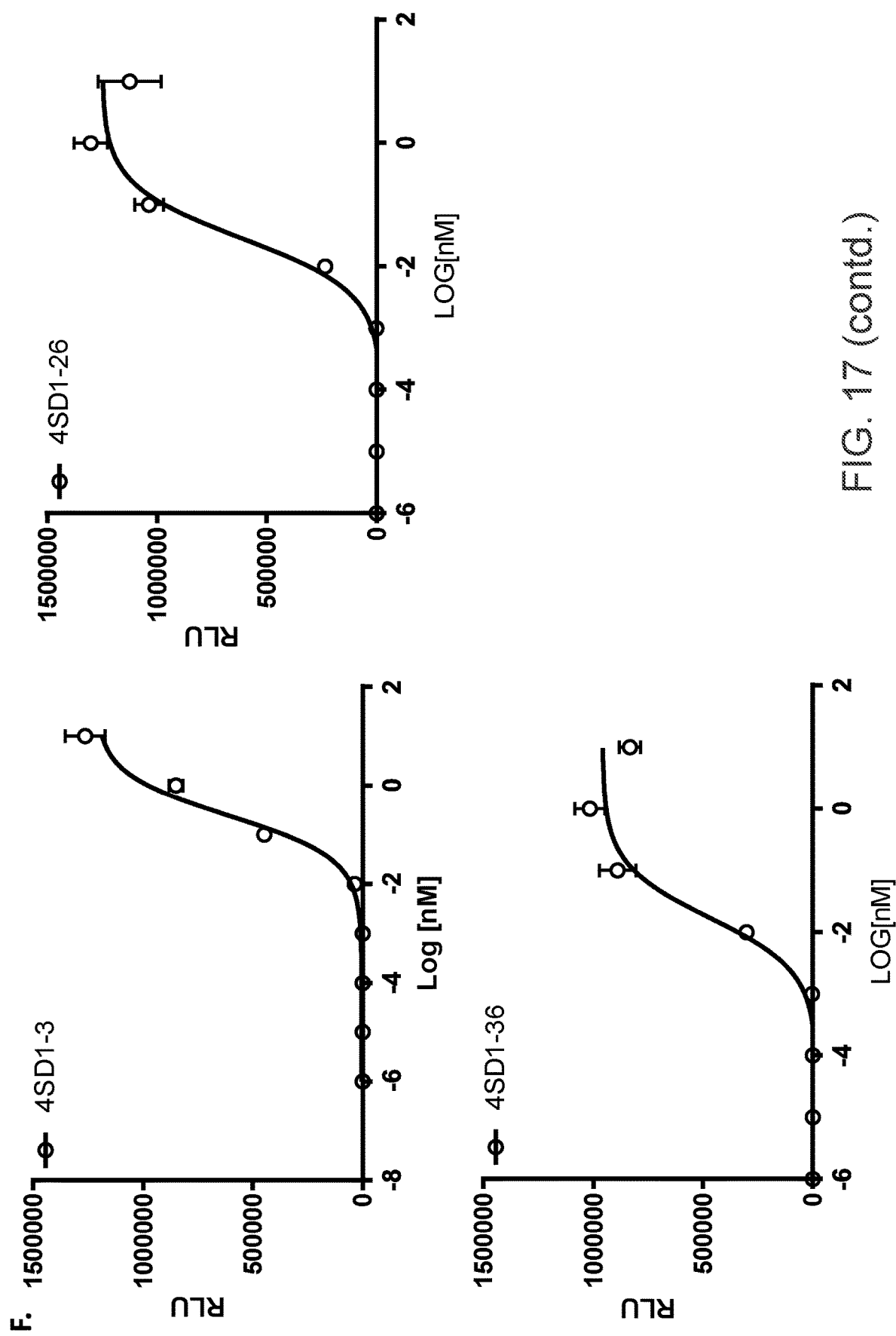
FIG. 17 (contd.)

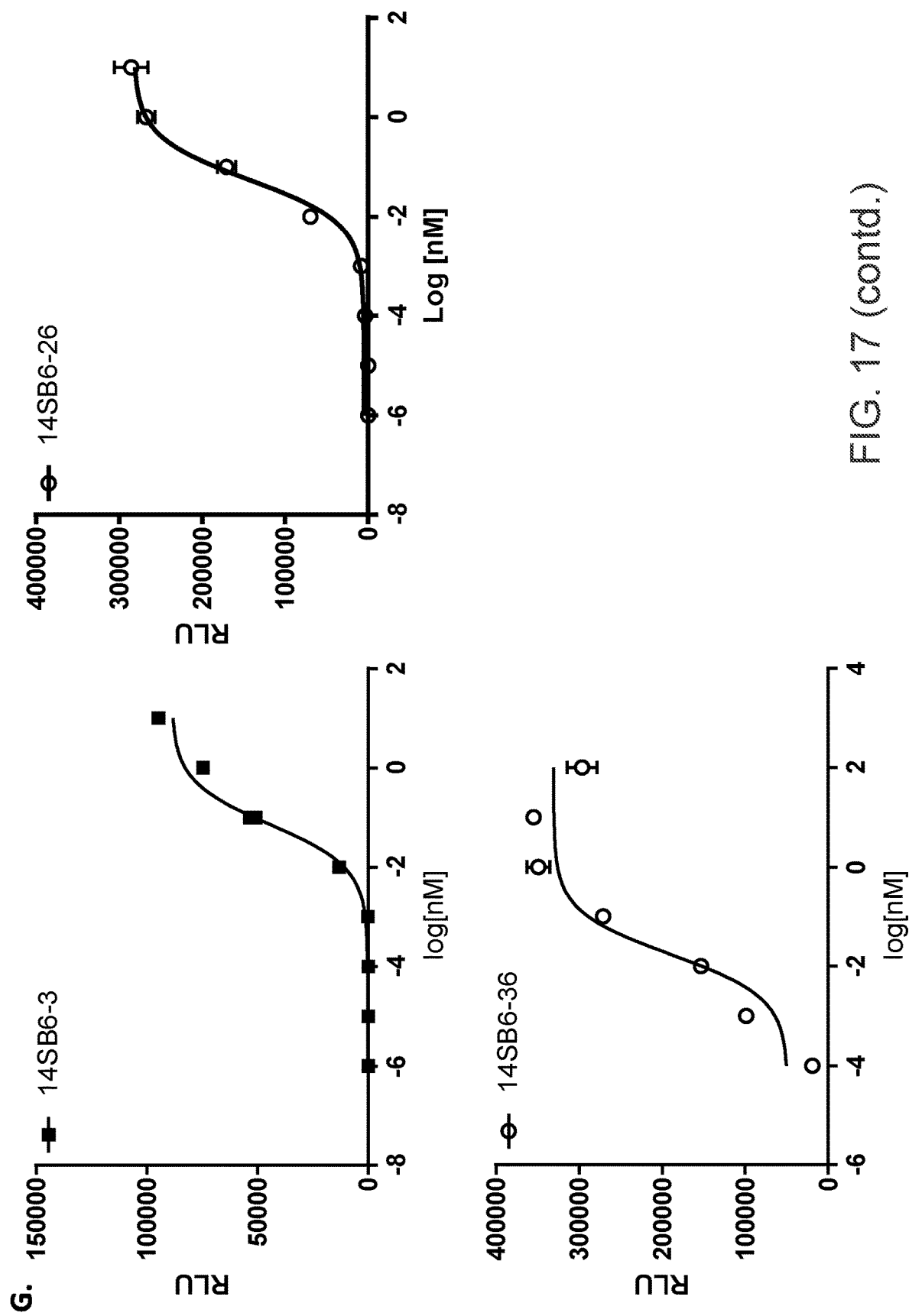
FIG. 17 (contd.)

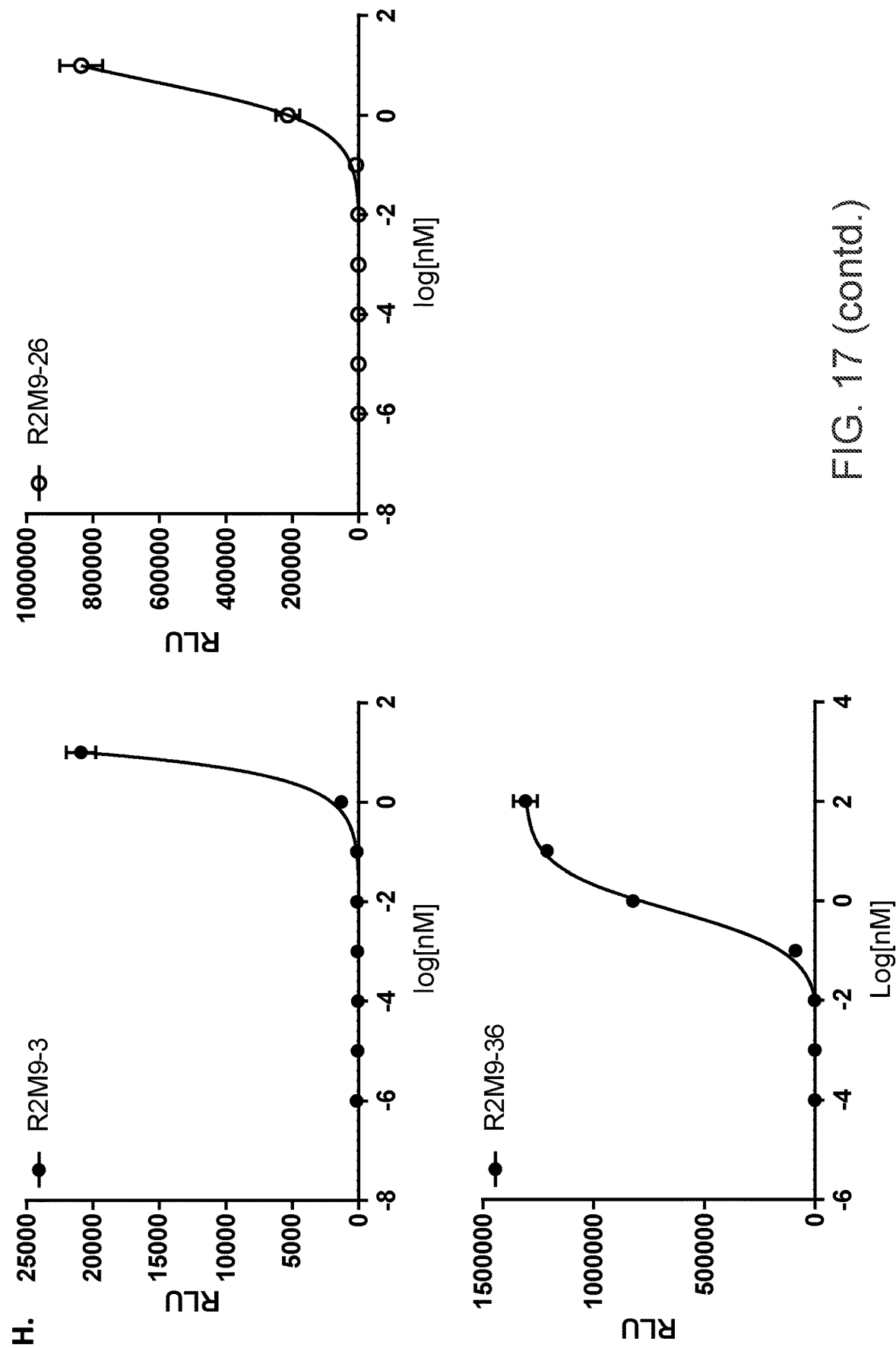
FIG. 17 (contd.)

FIG. 19

Leader = italics
Linker = underlined
VHH/sdAb or VH or VL = bold

*MYRMQLLSCIALSLALVTNS***DVQLVESGGGLVQPGGSLRLSCAASGSIFMINTMAWYRQAPGNQRE
LVATIRPVVSETTYADAVKGRFTISRDNAKNTVYLQMNSLKSEDTAIYYCNAKRPWGTRDEYWGQG
TLVTVSS**<u>GSGGS</u>QTVVLQEPSLSVSPGGTVTLTCGLSSGSVSTNYYPSWYQQTPGQAPRTLIYYTNT
RSSDVPERFSGSIVGNKAALTITGAQPDDESVYFCLLYLGRGIWVFGGGTKLTVLGQPKAAPSVTLFP
PSSEELQANKATLVCLISDFYPGAVTVAWKADSSPVKAGVETTTPSKQSNNKYAASSYLSLTPEQWK
SHRSYSCQVTHEGSTVEKTVAPTECS* (SEQ ID NO:89)

*MYRMQLLSCIALSLALVTNS***DVQLVESGGGLVQAGGSLRLACAGSGRIFAIYDIAWYRHPPGNQREL
VAMIRPVVTEIDYADSVKGRFTISRNNAMKTVYLQMNNLKPEDTAVYYCNAKRPWGSRDEYWGQG
TQVTVSS**<u>GSGGS</u>QTVVLQEPSLSVSPGGTVTLTCGLSSGSVSTNYYPSWYQQTPGQAPRTLIYYTNT
RSSDVPERFSGSIVGNKAALTITGAQPDDESVYFCLLYLGRGIWVFGGGTKLTVLGQPKAAPSVTLFP
PSSEELQANKATLVCLISDFYPGAVTVAWKADSSPVKAGVETTTPSKQSNNKYAASSYLSLTPEQWK
SHRSYSCQVTHEGSTVEKTVAPTECS* (SEQID NO:90)

*MYRMQLLSCIALSLALVTNS***EVQLVESGGGLVQAGGSLRVSCAASGGTFSRYHMGWFRQAPGKER
EFVSAITWSGGRTYYADFVKGRFTISRDDARNTVYLQMSSLKPEDTAVYYCALTWAPTPTNRRSDY
AYWGQGTQVTVSS**<u>GSGGS</u>QTVVLQEPSLSVSPGGTVTLTCGLSSGSVSTNYYPSWYQQTPGQAPR
TLIYYTNTRSSDVPERFSGSIVGNKAALTITGAQPDDESVYFCLLYLGRGIWVFGGGTKLTVLGQPKAA
PSVTLFPPSSEELQANKATLVCLISDFYPGAVTVAWKADSSPVKAGVETTTPSKQSNNKYAASSYLSL
TPEQWKSHRSYSCQVTHEGSTVEKTVAPTECS* (SEQ ID NO:91)

*MYRMQLLSCIALSLALVTNS***EVQLVESGGGLVQAGGSLRLACAGSGRIFAIYDMAWYRQAPGNQRE
LVATIRPVVSETTYADAVKGRFTISRSNAMKTVYLQMNSLKSEDTAIYYCNAKRPWGTRDEYWGQG
TLVTVSS**<u>GSGGS</u>QTVVLQEPSLSVSPGGTVTLTCGLSSGSVSTNYYPSWYQQTPGQAPRTLIYYTNT
RSSDVPERFSGSIVGNKAALTITGAQPDDESVYFCLLYLGRGIWVFGGGTKLTVLGQPKAAPSVTLFP
PSSEELQANKATLVCLISDFYPGAVTVAWKADSSPVKAGVETTTPSKQSNNKYAASSYLSLTPEQWK
SHRSYSCQVTHEGSTVEKTVAPTECS* (SEQ ID NO:92)

*MYRMQLLSCIALSLALVTNS***AVQLVESGGGLVQAGGSLRLACAGSGRIFAIYDIAWYRQAPGNQREL
VATIRPVVSETTYADAVKGRFTISRSNAMKTVYLQMNSLKSEDTAIYYCNAKRPWGTRDEYWGQGT
LVTVSS**<u>GSGGS</u>QTVVLQEPSLSVSPGGTVTLTCGLSSGSVSTNYYPSWYQQTPGQAPRTLIYYTNTR
SSDVPERFSGSIVGNKAALTITGAQPDDESVYFCLLYLGRGIWVFGGGTKLTVLGQPKAAPSVTLFPP
SSEELQANKATLVCLISDFYPGAVTVAWKADSSPVKAGVETTTPSKQSNNKYAASSYLSLTPEQWKS
HRSYSCQVTHEGSTVEKTVAPTECS* (SEQ ID NO:93)

*MYRMQLLSCIALSLALVTNS***AVQLVDSGGGLVQAGGSLRLSCAVSGRTFSMYDMGWFRQAPGKER
EFVASIRWSSGNTWYADSMKGRFTISRDNAKNTVYLQMNSLKPEDTAVYYCYANIYYTRRAPEEYW
GQGTLVTVSS**<u>GSGGS</u>QTVVLQEPSLSVSPGGTVTLTCGLSSGSVSTNYYPSWYQQTPGQAPRTLIY
YTNTRSSDVPERFSGSIVGNKAALTITGAQPDDESVYFCLLYLGRGIWVFGGGTKLTVLGQPKAAPSV
TLFPPSSEELQANKATLVCLISDFYPGAVTVAWKADSSPVKAGVETTTPSKQSNNKYAASSYLSLTPE
QWKSHRSYSCQVTHEGSTVEKTVAPTECS* (SEQ ID NO:94)

*MYRMQLLSCIALSLALVTNS***EVQLVQSGAEVKKPGASVKVSCKASGYTFTSYGISWVRQAPGQGLEW
MGWISAYNGNTNYAQKLQGRVTMTTDTSTSTAYMELRSLRSDDTAVYYCASSKEKATYYYGMDVW
GQGTTVTVSSASTKGPSVFPLAPSSKSTSGGTAALGCLVKDYFPEPVTVSWNSGALTSGVHTFPAVL
QSSGLYSLSSVVTVPSSSLGTQTYICNVNHKPSNTKVDKKVEPKSCDKTHTCPPCPAPELLGGPSVFL
FPPKPKDTLMISRTPEVTCVVVDVSHEDPEVKFNWYVDGVEVHNAKTKPREEQYNSTYRVVSVLTVL
HQDWLNGKEYKCKVSNKALPAPIEKTISKAKGQPREPQVYTLPPSREEMTKNQVSLTCLVKGFYPSDI
AVEWESNGQPENNYKTTPPVLDSDGSFFLYSKLTVDKSRWQQGNVFSCSVMHEALHNHYTQKSLSL
SPGK* (SEQ ID NO:95)**

FIG. 19 (contd.)

*MYRMQLLSCIALSLALVTNS*EVQLVESGGGLVQPGGSLRLSCTSSANINSIETLGWYRQAPGKQRELI
ANMRGGGYMKYAGSLKGRFTMSTESAKNTLYLQMNSLKPEDTAVYYCYARTQRMGVVNSYWGQ
GTLVTVSSGSGGSDIELTQPPSVSVAPGQTARISCSGDNIGSFYVHWYQQKPGQAPVLVIYDKSNRP
SGIPERFSGSNSGNTATLTISGTQAEDEADYYCQSYANTLSLVFGGGTKLTVLGQPKAAPSVTLFPPS
SEELQANKATLVCLISDFYPGAVTVAWKADSSPVKAGVETTTPSKQSNNKYAASSYLSLTPEQWKSH
RSYSCQVTHEGSTVEKTVAPTECS* (SEQ ID NO:96)

*MYRMQLLSCIALSLALVTNS*QVQLVESGGGLVQPGGSLRLSCTSSANINSIETLGWYRQAPGKQREL
IANMRGGGYMKYAGSLKGRFTMSTESAKNTLYLQMNSLKPEDTAVYFCNAVTYDGYTIRGQGTLVT
VSSGSGGSDIELTQPPSVSVAPGQTARISCSGDNIGSFYVHWYQQKPGQAPVLVIYDKSNRPSGIPER
FSGSNSGNTATLTISGTQAEDEADYYCQSYANTLSLVFGGGTKLTVLGQPKAAPSVTLFPPSSEELQA
NKATLVCLISDFYPGAVTVAWKADSSPVKAGVETTTPSKQSNNKYAASSYLSLTPEQWKSHRSYSCQ
VTHEGSTVEKTVAPTECS* (SEQ ID NO:97)

*MYRMQLLSCIALSLALVTNS*EVQLVESGGGLVQPGGSLRLSCTSSANINSIETLGWYRQAPGKQRELI
ANMRGGGYMKYADSVQGRFTISRDNAKNTVYLQMNSLKPEDTAVYYCAAQFRNDYGLRYQSTNN
YWGQGTLVTVSSGSGGSDIELTQPPSVSVAPGQTARISCSGDNIGSFYVHWYQQKPGQAPVLVIYDK
SNRPSGIPERFSGSNSGNTATLTISGTQAEDEADYYCQSYANTLSLVFGGGTKLTVLGQPKAAPSVTL
FPPSSEELQANKATLVCLISDFYPGAVTVAWKADSSPVKAGVETTTPSKQSNNKYAASSYLSLTPEQ
WKSHRSYSCQVTHEGSTVEKTVAPTECS* (SEQ ID NO:98)

*MYRMQLLSCIALSLALVTNS*QVQLVESGGGLVQPGGSLRLSCTSSANINSIETLGWYRQAPGKQREL
IANMRGGGYMKYAGSLKGRFTMSTESAKNTVYLQMNSLKPEDSAVYYCNANYRGNRYWGQGTLV
TVSSGSGGSDIELTQPPSVSVAPGQTARISCSGDNIGSFYVHWYQQKPGQAPVLVIYDKSNRPSGIPE
RFSGSNSGNTATLTISGTQAEDEADYYCQSYANTLSLVFGGGTKLTVLGQPKAAPSVTLFPPSSEELQ
ANKATLVCLISDFYPGAVTVAWKADSSPVKAGVETTTPSKQSNNKYAASSYLSLTPEQWKSHRSYSC
QVTHEGSTVEKTVAPTECS* (SEQ ID NO:99)

*MYRMQLLSCIALSLALVTNS*DVQLVESGGGLVQAGGSLRLACAGSGRIFAIYDIAWYRHPPGNQREL
VAMIRPVVTEIDYADSVKGRFTISRNNAMKTVYLQMNNLKPEDTAVYYCNAKRPWGSRDEYWGQG
TQVTVSSGSGGSDIELTQPPSVSVAPGQTARISCSGDNIGSFYVHWYQQKPGQAPVLVIYDKSNRPS
GIPERFSGSNSGNTATLTISGTQAEDEADYYCQSYANTLSLVFGGGTKLTVLGQPKAAPSVTLFPPSS
EELQANKATLVCLISDFYPGAVTVAWKADSSPVKAGVETTTPSKQSNNKYAASSYLSLTPEQWKSHR
SYSCQVTHEGSTVEKTVAPTECS* (SEQ ID NO:100)

*MYRMQLLSCIALSLALVTNS*EVQLVESGGGLVQAGGSLRVSCAASGGTFSRYHMGWFRQAPGKER
EFVSAITWSGGRTYYADFVKGRFTISRDDARNTVYLQMSSLKPEDTAVYYCALTWAPTPTNRRSDY
AYWGQGTQVTVSSGSGGSDIELTQPPSVSVAPGQTARISCSGDNIGSFYVHWYQQKPGQAPVLVIY
DKSNRPSGIPERFSGSNSGNTATLTISGTQAEDEADYYCQSYANTLSLVFGGGTKLTVLGQPKAAPSV
TLFPPSSEELQANKATLVCLISDFYPGAVTVAWKADSSPVKAGVETTTPSKQSNNKYAASSYLSLTPE
QWKSHRSYSCQVTHEGSTVEKTVAPTECS* (SEQ ID NO:101)

*MYRMQLLSCIALSLALVTNS*AVQLVESGGGLVQAGGSLRLACAGSGRIFAIYDIAWYRQAPGNQREL
VATIRPVVSETTYADAVKGRFTISRSNAMKTVYLQMNSLKSEDTAIYYCNAKRPWGTRDEYWGQGT
LVTVSSGSGGSDIELTQPPSVSVAPGQTARISCSGDNIGSFYVHWYQQKPGQAPVLVIYDKSNRPSGI
PERFSGSNSGNTATLTISGTQAEDEADYYCQSYANTLSLVFGGGTKLTVLGQPKAAPSVTLFPPSSEE
LQANKATLVCLISDFYPGAVTVAWKADSSPVKAGVETTTPSKQSNNKYAASSYLSLTPEQWKSHRSY
SCQVTHEGSTVEKTVAPTECS* (SEQ ID NO:102)

*MYRMQLLSCIALSLALVTNS*AVQLVDSGGGLVQAGGSLRLSCAVSGRTFSMYDMGWFRQAPGKER
EFVASIRWSSGNTWYADSMKGRFTISRDNAKNTVYLQMNSLKPEDTAVYYCYANIYYTRRAPEEYW
GQGTLVTVSSGSGGSDIELTQPPSVSVAPGQTARISCSGDNIGSFYVHWYQQKPGQAPVLVIYDKSN
RPSGIPERFSGSNSGNTATLTISGTQAEDEADYYCQSYANTLSLVFGGGTKLTVLGQPKAAPSVTLFP
PSSEELQANKATLVCLISDFYPGAVTVAWKADSSPVKAGVETTTPSKQSNNKYAASSYLSLTPEQWK
SHRSYSCQVTHEGSTVEKTVAPTECS* (SEQ ID NO:103)

FIG. 19 (contd.)

*MYRMQLLSCIALSLALVTNSE*VQLVESGGGLVQPGGSLRLSCAASGFTFSHYTLSWVRQAPGKGLE
WVSVISGDGSYTYYADSVKGRFTISSDNSKNTLYLQMNSLRAEDTAVYYCARNFIKYVFANWGQGT
LVTVSSASTKGPSVFPLAPSSKSTSGGTAALGCLVKDYFPEPVTVSWNSGALTSGVHTFPAVLQSSG
LYSLSSVVTVPSSSLGTQTYICNVNHKPSNTKVDKKVEPKSCDKTHTCPPCPAPEAAGGPSVFLFPPK
PKDTLMISRTPEVTCVVVDVSHEDPEVKFNWYVDGVEVHNAKTKPREEQYNSTYRVVSVLTVLHQD
WLNGKEYKCKVSNKALGAPIEKTISKAKGQPREPQVYTLPPSREEMTKNQVSLTCLVKGFYPSDIAVE
WESNGQPENNYKTTPPVLDSDGSFFLYSKLTVDKSRWQQGNVFSCSVMHEALHNHYTQKSLSLSPG
K* (SEQ ID NO:104)

*MDMRVPAQLLGLLLLWLRGARC*DVQLVESGGGLVQAGGSLRLACAGSGRIFAIYDIAWYRHPPGNQ
RELVAMIRPVVTEIDYADSVKGRFTISRNNAMKTVYLQMNNLKPEDTAVYYCNAKRPWGSRDEYWG
QGTQVTVSS<u>GSGSG</u>DVVMTQSPLSLPVTPGEPASISCRSSQSLLHSNGYNYLDWYLQKPGQSPQLLI
YLGSNRASGVPDRFSGSGSGTDFTLKISRVEAEDVGVYYCMQGTHWPYTFGQGTKLEIKRTVAAPSV
FIFPPSDEQLKSGTASVVCLLNNFYPREAKVQWKVDNALQSGNSQESVTEQDSKDSTYSLSSTLTLSK
ADYEKHKVYACEVTHQGLSSPVTKSFNRGEC* (SEQ ID NO:105)

*MDMRVPAQLLGLLLLWLRGARC*DVQLVESGGGLVQAGGSLRLACAGSGRIFAIYDIAWYRHPPGNQ
RELVAMIRPVVTEIDYADSVKGRFTISRNNAMKTVYLQMNNLKPEDTAVYYCNAKRPWGSRDEYWG
QGTQVTVSS<u>GSGSG</u>DIVMTHTPLSLSVTPGEPASISCRSSRSLLDTDDGNTYLDWYLQKPGQSPQLLI
HTLSHRASGVPDRFSGSGSGTDFTLKISRVEAEDVGVYYCMQSIQLPWTFGQGTKVEIKRTVAAPSV
FIFPPSDEQLKSGTASVVCLLNNFYPREAKVQWKVDNALQSGNSQESVTEQDSKDSTYSLSSTLTLSK
ADYEKHKVYACEVTHQGLSSPVTKSFNRGEC* (SEQ ID NO:106)

*MDMRVPAQLLGLLLLWLRGARC*DVQLVESGGGLVQAGGSLRLACAGSGRIFAIYDIAWYRHPPGNQ
RELVAMIRPVVTEIDYADSVKGRFTISRNNAMKTVYLQMNNLKPEDTAVYYCNAKRPWGSRDEYWG
QGTQVTVSS<u>GSGSG</u>SYVLTQPPSVSVSPGQTASITCSGDKVGHKYASWYQQKPGQSPVLVIYEDSQ
RPSGIPVRFSGSNSGNTATLTISGTQAMDEADYYCQAWDSSTDVVFGGGTKLTVLGQPKAAPSVTLF
PPSSEELQANKATLVCLISDFYPGAVTVAWKADSSPVKAGVETTTPSKQSNNKYAASSYLSLTPEQW
KSHRSYSCQVTHEGSTVEKTVAPTECS* (SEQ ID NO:107)

*MDMRVPAQLLGLLLLWLRGARC*DVQLVESGGGLVQAGGSLRLACAGSGRIFAIYDIAWYRHPPGNQ
RELVAMIRPVVTEIDYADSVKGRFTISRNNAMKTVYLQMNNLKPEDTAVYYCNAKRPWGSRDEYWG
QGTQVTVSS<u>GSGSG</u>QSVVTQPPSVSGAPGQRVTISCTRSSSNIGAYDVHWYQQHPGTAPKLLIFG
NSIRPSGVPDRFSGSKSGTSATLGITGLQTGDEADYYCGTWDSSLSAWVFGGGTKLTVLGQPKAAPS
VTLFPPSSEELQANKATLVCLISDFYPGAVTVAWKADSSPVKAGVETTTPSKQSNNKYAASSYLSLTP
EQWKSHRSYSCQVTHEGSTVEKTVAPTECS* (SEQ ID NO:108)

*MDMRVPAQLLGLLLLWLRGARC*DVQLVESGGGLVQAGGSLRLACAGSGRIFAIYDIAWYRHPPGNQ
RELVAMIRPVVTEIDYADSVKGRFTISRNNAMKTVYLQMNNLKPEDTAVYYCNAKRPWGSRDEYWG
QGTQVTVSS<u>GSGSG</u>EIVLTQSPATLSLSPGEGATLSCRASQSVGTYLTWYRQKPGQAPRLLIYDASN
RATGIPARFSGSGAGTDFTLKISRVEAEDVGVYYCMQATQFPLTFGQGTKVEIKRTVAAPSVFIFPPSD
EQLKSGTASVVCLLNNFYPREAKVQWKVDNALQSGNSQESVTEQDSKDSTYSLSSTLTLSKADYEKH
KVYACEVTHQGLSSPVTKSFNRGEC* (SEQ ID NO:109)

*MDMRVPAQLLGLLLLWLRGARC*DVQLVESGGGLVQAGGSLRLACAGSGRIFAIYDIAWYRHPPGNQ
RELVAMIRPVVTEIDYADSVKGRFTISRNNAMKTVYLQMNNLKPEDTAVYYCNAKRPWGSRDEYWG
QGTQVTVSS<u>GSGSG</u>DIQLTQSPSSLSASVGDRVTITCRASRSISSYFNWYQQKPGKAPKLLIYAASSL
QSGVPSRFSGSRSGTDFTLTISSLQPEDFATYYCQQADTFPPTFGQGTRLEIKRTVAAPSVFIFPPSDE
QLKSGTASVVCLLNNFYPREAKVQWKVDNALQSGNSQESVTEQDSKDSTYSLSSTLTLSKADYEKHK
VYACEVTHQGLSSPVTKSFNRGEC* (SEQ ID NO:110)

*MDMRVPAQLLGLLLLWLRGARC*QVQLQESGPGLVKPSETLSLTCTVSGGSISGNNYYWGWIRQPPG
KGLEWIGSIYFTGGTYYNPSLKSRVTISVDTSKNQFSLKLSSVTAADTAVYYCARVMLITDAFDIWGQ
GTMVTVSSASTKGPSVFPLAPSSKSTSGGTAALGCLVKDYFPEPVTVSWNSGALTSGVHTFPAVLQS
SGLYSLSSVVTVPSSSLGTQTYICNVNHKPSNTKVDKKVEPKSCDKTHTCPPCPAPELLGGPSVFLFP
PKPKDTLMISRTPEVTCVVVDVSHEDPEVKFNWYVDGVEVHNAKTKPREEQYNSTYRVVSVLTVLHQ
DWLNGKEYKCKVSNKALPAPIEKTISKAKGQPREPQVYTLPPSREEMTKNQVSLTCLVKGFYPSDIAV

FIG. 19 (contd.)

EWESNGQPENNYKTTPPVLDSDGSFFLYSKLTVDKSRWQQGNVFSCSVMHEALHNHYTQKSLSLSP
GK<u>GSGSG</u>HHHHHH** (SEQ ID NO:111)

*MDMRVPAQLLGLLLLWLRGARC*QLQLQESGSGLVKPSQTLSLTCAVSGGSISSGGYSWSWIRQPP
GKGLEWIGSIYHSGSTYYNPSLKSRLTISVDTSKNQFSLKLSSVTAADTAVYYCARFYYDILTGYSYF
DYWGQGTLVTVSSASTKGPSVFPLAPSSKSTSGGTAALGCLVKDYFPEPVTVSWNSGALTSGVHTF
PAVLQSSGLYSLSSVVTVPSSSLGTQTYICNVNHKPSNTKVDKKVEPKSCDKTHTCPPCPAPELLGGP
SVFLFPPKPKDTLMISRTPEVTCVVVDVSHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNHYTQK
SLSLSPGK<u>153</u>HHHHHH** (SEQ ID NO:112)

*MDMRVPAQLLGLLLLWLRGARC*QVQLQQWGAGLLKPSETLSLTCAVSGASFSGHYWTWIRQPPGK
GLEWIGEIDHTGSTNYEPSLRSRVTISVDTSKNQFSLNLKSVTAADTAVYYCARGGQGGYDWGHYH
GLDVWGQGTTVTVSSASTKGPSVFPLAPSSKSTSGGTAALGCLVKDYFPEPVTVSWNSGALTSGVH
TFPAVLQSSGLYSLSSVVTVPSSSLGTQTYICNVNHKPSNTKVDKKVEPKSCDKTHTCPPCPAPEAAG
GPSVFLFPPKPKDTLMISRTPEVTCVVVDVSHEDPEVKFNWYVDGVEVHNAKTKPREEQYNSTYRVV
SVLTVLHQDWLNGKEYKCKVSNKALGAPIEKTISKAKGQPREPQVYTLPPSREEMTKNQVSLTCLVKG
FYPSDIAVEWESNGQPENNYKTTPPVLDSDGSFFLYSKLTVDKSRWQQGNVFSCSVMHEALHNHYT
QKSLSLSPGK<u>GSGSG</u>HHHHHH* (SEQ ID NO:113)

*MDMRVPAQLLGLLLLWLRGARC*QVQLQESGPGLVKPSETLSLTCTVSGGSISSSSYYWGWIRQHPG
KGLEWIGYIYYSGSTYYNPSLKSRVTISVDTSKNQFSLKLNSVTAADTAVYYCARATYGGDAFDIWG
QGTMVTVSSASTKGPSVFPLAPSSKSTSGGTAALGCLVKDYFPEPVTVSWNSGALTSGVHTFPAVLQ
SSGLYSLSSVVTVPSSSLGTQTYICNVNHKPSNTKVDKKVEPKSCDKTHTCPPCPAPELLGGPSVFLF
PPKPKDTLMISRTPEVTCVVVDVSHEDPEVKFNWYVDGVEVHNAKTKPREEQYNSTYRVVSVLTVLH
QDWLNGKEYKCKVSNKALPAPIEKTISKAKGQPREPQVYTLPPSREEMTKNQVSLTCLVKGFYPSDIA
VEWESNGQPENNYKTTPPVLDSDGSFFLYSKLTVDKSRWQQGNVFSCSVMHEALHNHYTQKSLSLS
PGK<u>GSGSG</u>HHHHHH** (SEQ ID NO:114)

*MDMRVPAQLLGLLLLWLRGARC*QVQLQESGPGLVKPSETLSLTCTVSGGAISGTSYFWGWIRQPPG
KGLEWIGSIYYTGNTYYNPSLKSRLTVSVDTSKNQFSLNLNSVTAADTATYYCARIGIAVAAPVDHW
GQGTLVTVSSASTKGPSVFPLAPSSKSTSGGTAALGCLVKDYFPEPVTVSWNSGALTSGVHTFPAVL
QSSGLYSLSSVVTVPSSSLGTQTYICNVNHKPSNTKVDKKVEPKSCDKTHTCPPCPAPELLGGPSVFL
FPPKPKDTLMISRTPEVTCVVVDVSHEDPEVKFNWYVDGVEVHNAKTKPREEQYNSTYRVVSVLTVL
HQDWLNGKEYKCKVSNKALPAPIEKTISKAKGQPREPQVYTLPPSREEMTKNQVSLTCLVKGFYPSDI
AVEWESNGQPENNYKTTPPVLDSDGSFFLYSKLTVDKSRWQQGNVFSCSVMHEALHNHYTQKSLSL
SPGK<u>GSGSG</u>HHHHHH* (SEQ ID NO:115)

*MDMRVPAQLLGLLLLWLRGARC*QLQLQESGPGLVKPSQTLSLTCTVSGGSISSGGYYWSWIRQHPG
KGLEWIGYIYYSGSTYYNPSLKSRVTISVDKSKNQFSLKLSSVTAADTAVYYCARVRDYYDSSGYYY
DYFDYWGQGTLVTVSSASTKGPSVFPLAPSSKSTSGGTAALGCLVKDYFPEPVTVSWNSGALTSGV
HTFPAVLQSSGLYSLSSVVTVPSSSLGTQTYICNVNHKPSNTKVDKKVEPKSCDKTHTCPPCPAPELL
GGPSVFLFPPKPKDTLMISRTPEVTCVVVDVSHEDPEVKFNWYVDGVEVHNAKTKPREEQYNSTYRV
VSVLTVLHQDWLNGKEYKCKVSNKALPAPIEKTISKAKGQPREPQVYTLPPSREEMTKNQVSLTCLVK
GFYPSDIAVEWESNGQPENNYKTTPPVLDSDGSFFLYSKLTVDKSRWQQGNVFSCSVMHEALHNHY
TQKSLSLSPGK<u>GSGSG</u>HHHHHH** (SEQ ID NO:116)

FIG. 19 (contd.)

MDMRVPAQLLGLLLLWLRGARCEVQLVQSGAEVKKPGASVKVSCKASGYTFTSYGISWVRQAPGQG
LEWMGWISAYNGNTNYAQKLQGRVTMTTDTSTSTAYMELRSLRSDDTAVYYCASSKEKATYYYGMD
VWGQGTTVTVSSASTKGPSVFPLAPSSKSTSGGTAALGCLVKDYFPEPVTVSWNSGALTSGVHTFPA
VLQSSGLYSLSSVVTVPSSSLGTQTYICNVNHKPSNTKVDKKVEPKSCDKTHTCPPCPAPEAAGGPS
VFLFPPKPKDTLMISRTPEVTCVVVDVSHEDPEVKFNWYVDGVEVHNAKTKPREEQYNSTYRVVSVL
TVLHQDWLNGKEYKCKVSNKALGAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNHYTQK
SLSLSPGK<u>GSGSG</u>DVQLVESGGGLVQAGGSLRLACAGSGRIFAIYDIAWYRHPPGNQRELVAMIRP
VVTEIDYADSVKGRFTISRNNAMKTVYLQMNNLKPEDTAVYYCNAKRPWGSRDEYWGQGTQVTVS
S* (SEQ ID NO:117)

*MDMRVPAQLLGLLLLWLRGARC*DVQLVESGGGLVQAGGSLRLACAGSGRIFAIYDIAWYRHPPGNQ
RELVAMIRPVVTEIDYADSVKGRFTISRNNAMKTVYLQMNNLKPEDTAVYYCNAKRPWGSRDEYWG
QGTQVTVSS<u>GSGSG</u>EVQLVQSGAEVKKPGASVKVSCKASGYTFTSYGISWVRQAPGQGLEWMGWI
SAYNGNTNYAQKLQGRVTMTTDTSTSTAYMELRSLRSDDTAVYYCASSKEKATYYYGMDVWGQGTT
VTVSSASTKGPSVFPLAPSSKSTSGGTAALGCLVKDYFPEPVTVSWNSGALTSGVHTFPAVLQSSGL
YSLSSVVTVPSSSLGTQTYICNVNHKPSNTKVDKKVEPKSCDKTHTCPPCPAPEAAGGPSVFLFPPKP
KDTLMISRTPEVTCVVVDVSHEDPEVKFNWYVDGVEVHNAKTKPREEQYNSTYRVVSVLTVLHQDWL
NGKEYKCKVSNKALGAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK*
(SEQ ID NO:118)

*MDMRVPAQLLGLLLLWLRGARC*QAVVLQEPSLSVSPGGTVTLTCGLSSGSVSTNYYPSWYQQTPGQ
APRTLIYYTNTRSSDVPERFSGSIVGNKAALTITGAQPDDESVYFCLLYLGRGIWVFGGGTKLTVLGQP
KKAAPSVTLFPPSSEELQANKATLVCLISDFYPGAVTVAWKADSSPVKAGVETTTPSKQSNNKYAASSY
LSLTPEQWKSHRSYSCQVTHEGSTVEKTVAPTECS<u>GSGSG</u>DVQLVESGGGLVQAGGSLRLACAGS
GRIFAIYDIAWYRHPPGNQRELVAMIRPVVTEIDYADSVKGRFTISRNNAMKTVYLQMNNLKPEDTAV
YYCNAKRPWGSRDEYWGQGTQVTVSS* (SEQ ID NO:119)

*MDMRVPAQLLGLLLLWLRGARC*DVQLVESGGGLVQAGGSLRLACAGSGRIFAIYDIAWYRHPPGNQ
RELVAMIRPVVTEIDYADSVKGRFTISRNNAMKTVYLQMNNLKPEDTAVYYCNAKRPWGSRDEYWG
QGTQVTVSS<u>GSGSG</u>QAVVLQEPSLSVSPGGTVTLTCGLSSGSVSTNYYPSWYQQTPGQAPRTLIYY
TNTRSSDVPERFSGSIVGNKAALTITGAQPDDESVYFCLLYLGRGIWVFGGGTKLTVLGQPKAAPSVT
LFPPSSEELQANKATLVCLISDFYPGAVTVAWKADSSPVKAGVETTTPSKQSNNKYAASSYLSLTPEQ
WKSHRSYSCQVTHEGSTVEKTVAPTECS* (SEQ ID NO:120)

*MDMRVPAQLLGLLLLWLRGARC*EVQLVQSGAEVKKPGASVKVSCKASGYTFTSYGISWVRQAPGQ
GLEWMGWISAYNGNTNYAQKLQGRVTMTTDTSTSTAYMELRSLRSDDTAVYYCASSKEKATYYYG
MDVWGQGTTVTVSSASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSC<u>GSGSG</u>HHHHHH* (SEQ
ID NO:122)

*MYRMQLLSCIALSLALVTNS*AVQLVDSGGGLVQAGGSLRLSCAVSGRTFSMYDMGWFRQAPGKER
EFVASIRWSSGNTWYADSMKGRFTISRDNAKNTVYLQMNSLKPEDTAVYYCYANIYYTRRAPEEYW
GQGTLVTVSS<u>GSGGS</u>QTVVLQEPSLSVSPGGTVTLTCGLSSGSVSTNYYPSWYQQTPGQAPRTLIY
YTNTRSSDVPERFSGSIVGNKAALTITGAQPDDESVYFCLLYLGRGIWVFGGGTKLTVLGQPKAAPSV
TLFPPSSEELQANKATLVCLISDFYPGAVTVAWKADSSPVKAGVETTTPSKQSNNKYAASSYLSLTPE
QWKSHRSYSCQVTHEGSTVEKTVAPTECS* (SEQ ID NO:123)

*MDMRVPAQLLGLLLLWLRGARC*EVQLVQSGAEVKKPGASVKVSCKASGYTFTSYGISWVRQAPGQ
GLEWMGWISAYNGNTNYAQKLQGRVTMTTDTSTSTAYMELRSLRSDDTAVYYCASSKEKATYYYG
MDVWGQGTTVTVSSASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSC<u>GSGSG</u>HHHHHH* (SEQ
ID NO:124)

FIG. 19 (contd.)

*MDMRVPAQLLGLLLLWLRGARC*QAVVLQEPSLSVSPGGTVTLTCGLSSGSVSTNYYPSWYQQTPG
QAPRTLIYYTNTRSSDVPERFSGSIVGNKAALTITGAQPDDESVYFCLLYLGRGIWVFGGGTKLTVLG
QPKAAPSVTLFPPSSEELQANKATLVCLISDFYPGAVTVAWKADSSPVKAGVETTTPSKQSNNKYAAS
SYLSLTPEQWKSHRSYSCQVTHEGSTVEKTVAPTECS* (SEQ ID NO:125)

*MDMRVPAQLLGLLLLWLRGARC*EVQLVQSGAEVKKPGASVKVSCKASGYTFTSYGISWVRQAPGQ
GLEWMGWISAYNGNTNYAQKLQGRVTMTTDTSTSTAYMELRSLRSDDTAVYYCASSKEKATYYYG
MDVWGQGTTVTVSSASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPEAAG
GPSVFLFPPKPKDTLMISRTPEVTCVVVDVSHEDPEVKFNWYVDGVEVHNAKTKPREEQYNSTYRVV
SVLTVLHQDWLNGKEYKCKVSNKALGAPIEKTISKAKGQPREPQVYTLPPSREEMTKNQVSLWCLVK
GFYPSDIAVEWESNGQPENNYKTTPPVLDSDGSFFLYSKLTVDKSRWQQGNVFSCSVMHEALHNHY
TQKSLSLSPGK* (SEQ ID NO:126)

*MDMRVPAQLLGLLLLWLRGARC*DVQLVESGGGLVQAGGSLRLACAGSGRIFAIYDIAWYRHPPGNQ
RELVAMIRPVVTEIDYADSVKGRFTISRNNAMKTVYLQMNNLKPEDTAVYYCNAKRPWGSRDEYWG
QGTQVTVSSDKTHTCPPCPAPEAAGGPSVFLFPPKPKDTLMISRTPEVTCVVVDVSHEDPEVKFNWY
VDGVEVHNAKTKPREEQYNSTYRVVSVLTVLHQDWLNGKEYKCKVSNKALGAPIEKTISKAKGQPRE
PQVYTLPPSREEMTKNQVSLSCAVKGFYPSDIAVEWESNGQPENNYKTTPPVLDSDGSFFLVSKLTV
DKSRWQQGNVFSCSVMHEALHNHYTQKSLSLSPGKGSGSGHHHHHH* (SEQ ID NO:127)

*MDMRVPAQLLGLLLLWLRGARC*DVQLVESGGGLVQAGGSLRLACAGSGRIFAIYDIAWYRHPPGNQ
RELVAMIRPVVTEIDYADSVKGRFTISRNNAMKTVYLQMNNLKPEDTAVYYCNAKRPWGSRDEYWG
QGTQVTVSSDKTHTCPPCPAPEAAGGPSVFLFPPKPKDTLMISRTPEVTCVVVDVSHEDPEVKFNWY
VDGVEVHNAKTKPREEQYNSTYRVVSVLTVLHQDWLNGKEYKCKVSNKALGAPIEKTISKAKGQPRE
PQVYTLPPSREEMTKNQVSLTCLVKGFYPSDIAVEWESNGQPENNYKTTPPVLDSDGSFFLYSKLTV
DKSRWQQGNVFSCSVMHEALHNHYTQKSLSLSPGKGGSGSAVQQVESGGGLVQPGGSLRLSCAA
SGFTLDYYAISWFRQAPGKKRELVADITSGGSTNYADSVKGRFTISRDNAKNTIYLQMNSLKPEDTA
VYFCNAVTYNGYTIWGQGTQVTVSS* (SEQ ID NO:128)

*MDMRVPAQLLGLLLLWLRGARC*DVQLVESGGGLVQPGGSLRLSCTSSANINSIETLGWYRQAPGKQ
RELIANMRGGGYMKYAGSLKGRFTMSTESAKNTMYLQMNSLKPEDTAVYYCYVKLRDDDYVYRGQ
GTQVTVSSGSGSGSYVLTQPPSVSVSPGQTASITCSGDKVGHKYASWYQQKPGQSPVLVIYEDSQR
PSGIPVRFSGSNSGNTATLTISGTQAMDEADYYCQAWDSSTDVVFGGGTKLTVLGQPKAAPSVTLFP
PSSEELQANKATLVCLISDFYPGAVTVAWKADSSPVKAGVETTTPSKQSNNKYAASSYLSLTPEQWK
SHRSYSCQVTHEGSTVEKTVAPTECS* (SEQ ID NO:134)

*MDMRVPAQLLGLLLLWLRGARC*QVKLEESGGGLVQAGGSLRLSCAASGRIFSIYDMGWFRQAPGK
EREFVSGIRWSGGTSYADSVKGRFTISKDNAKNTIYLQMNNLKAEDTAVYYCGSRGYWGQGTLVTV
SSGSGSGSYVLTQPPSVSVSPGQTASITCSGDKVGHKYASWYQQKPGQSPVLVIYEDSQRPSGIPVR
FSGSNSGNTATLTISGTQAMDEADYYCQAWDSSTDVVFGGGTKLTVLGQPKAAPSVTLFPPSSEELQ
ANKATLVCLISDFYPGAVTVAWKADSSPVKAGVETTTPSKQSNNKYAASSYLSLTPEQWKSHRSYSC
QVTHEGSTVEKTVAPTECS* SEQ ID NO:135)

*MDMRVPAQLLGLLLLWLRGARC*DVQLVESGGGLVQPGGSLRLSCTSSANINSIETLGWYRQAPGKQ
RELIANMRGGGYMKYAGSLKGRFTMSTESAKNTMYLQMNSLKPEDTAVYYCYVKLRDDDYVYRGQ
GTQVTVSSGGSGSGSGDIQMTQSPSSLSASVGDRVTITCRASQSISSYLNWYQQKPGKAPKLLIYAA
SSLQSGVPSRFSGSGSGTDFTLTISSLQPEDFATYYCQQSYSTPLTFGGGTKVEIKRTVAAPSVFIFPP
SDEQLKSGTASVVCLLNNFYPREAKVQWKVDNALQSGNSQESVTEQDSKDSTYSLSSTLTLSKADYE
KHKVYACEVTHQGLSSPVTKSFNRGEC* (SEQ ID NO:136)

*MDMRVPAQLLGLLLLWLRGARC*DVQLVESGGGLVQAGGSLRLACAGSGRIFAIYDIAWYRHPPGNQ
RELVAMIRPVVTEIDYADSVKGRFTISRNNAMKTVYLQMNNLKPEDTAVYYCNAKRPWGSRDEYWG
QGTQVTVSSGSGSGDIQMTQSPSSLSASVGDRVTITCRASQSISSYLNWYQQKPGKAPKLLIYAASSL
QSGVPSRFSGSGSGTDFTLTISSLQPEDFATYYCQQSYSTPLTFGGGTKVEIKRTVAAPSVFIFPPSDE
QLKSGTASVVCLLNNFYPREAKVQWKVDNALQSGNSQESVTEQDSKDSTYSLSSTLTLSKADYEKHK
VYACEVTHQGLSSPVTKSFNRGEC* (SEQ ID NO:137)

FIG. 19 (contd.)

*MDMRVPAQLLGLLLLWLRGARC*QVKLEESGGGLVQAGGSLRLSCAASGRIFSIYDMGWFRQAPGK
EREFVSGIRWSGGTSYADSVKGRFTISKDNAKNTIYLQMNNLKAEDTAVYYCGSRGYWGQGTLVTV
SS<u>GSGSG</u>DIQMTQSPSSLSASVGDRVTITCRASQSISSYLNWYQQKPGKAPKLLIYAASSLQSGVPSR
FSGSGSGTDFTLTISSLQPEDFATYYCQQSYSTPLTFGGGTKVEIKRTVAAPSVFIFPPSDEQLKSGTA
SVVCLLNNFYPREAKVQWKVDNALQSGNSQESVTEQDSKDSTYSLSSTLTLSKADYEKHKVYACEVT
HQGLSSPVTKSFNRGEC* (SEQ ID NO:138)

*MDMRVPAQLLGLLLLWLRGARC*DVQLVESGGGLVQPGGSLRLSCTSSANINSIETLGWYRQAPGKQ
RELIANMRGGGYMKYAGSLKGRFTMSTESAKNTMYLQMNSLKPEDTAVYYCYVKLRDDDYVYRGQ
GTQVTVSS<u>GSGSG</u>QAVVLQEPSLSVSPGGTVTLTCGLSSGSVSTNYYPSWYQQTPGQAPRTLIYYT
NTRSSDVPERFSGSIVGNKAALTITGAQPDDESVYFCLLYLGRGIWVFGGGTKLTVLGQPKAAPSVTL
FPPSSEELQANKATLVCLISDFYPGAVTVAWKADSSPVKAGVETTTPSKQSNNKYAASSYLSLTPEQ
WKSHRSYSCQVTHEGSTVEKTVAPTECS* (SEQ ID NO:139)

*MDMRVPAQLLGLLLLWLRGARC*QVKLEESGGGLVQAGGSLRLSCAASGRIFSIYDMGWFRQAPGK
EREFVSGIRWSGGTSYADSVKGRFTISKDNAKNTIYLQMNNLKAEDTAVYYCGSRGYWGQGTLVTV
SS<u>GSGSG</u>QAVVLQEPSLSVSPGGTVTLTCGLSSGSVSTNYYPSWYQQTPGQAPRTLIYYTNTRSSDV
PERFSGSIVGNKAALTITGAQPDDESVYFCLLYLGRGIWVFGGGTKLTVLGQPKAAPSVTLFPPSSEEL
QANKATLVCLISDFYPGAVTVAWKADSSPVKAGVETTTPSKQSNNKYAASSYLSLTPEQWKSHRSYS
CQVTHEGSTVEKTVAPTECS* (SEQ ID NO:140)

*MDMRVPAQLLGLLLLWLRGARC*DVQLVESGGGLVQPGGSLRLSCTSSANINSIETLGWYRQAPGKQ
RELIANMRGGGYMKYAGSLKGRFTMSTESAKNTMYLQMNSLKPEDTAVYYCYVKLRDDDYVYRGQ
GTQVTVSS<u>GGSGS</u>DIQMTQSPSSLSASVGDRVTITCRASQGISSYLAWYQQKPGKAPKLLIYAASNLL
GGVPSRFSGSGSGTDFTLTISSLQPEDFATYYCQQTYSTPWTFGQGTKVEIKRTVAAPSVFIFPPSDE
QLKSGTASVVCLLNNFYPREAKVQWKVDNALQSGNSQESVTEQDSKDSTYSLSSTLTLSKADYEKHK
VYACEVTHQGLSSPVTKSFNRGEC* (SEQ ID NO:141)

*MDMRVPAQLLGLLLLWLRGARC*DVQLVESGGGLVQAGGSLRLACAGSGRIFAIYDIAWYRHPPGNQ
RELVAMIRPVVTEIDYADSVKGRFTISRNNAMKTVYLQMNNLKPEDTAVYYCNAKRPWGSRDEYWG
QGTQVTVSS<u>GSGGS</u>DIQMTQSPSSLSASVGDRVTITCRASQGISSYLAWYQQKPGKAPKLLIYAASNL
LGGVPSRFSGSGSGTDFTLTISSLQPEDFATYYCQQTYSTPWTFGQGTKVEIKRTVAAPSVFIFPPSD
EQLKSGTASVVCLLNNFYPREAKVQWKVDNALQSGNSQESVTEQDSKDSTYSLSSTLTLSKADYEKH
KVYACEVTHQGLSSPVTKSFNRGEC* (SEQ ID NO:142)

*MDMRVPAQLLGLLLLWLRGARC*QVKLEESGGGLVQAGGSLRLSCAASGRIFSIYDMGWFRQAPGK
EREFVSGIRWSGGTSYADSVKGRFTISKDNAKNTIYLQMNNLKAEDTAVYYCGSRGYWGQGTLVTV
SS<u>GGSGS</u>DIQMTQSPSSLSASVGDRVTITCRASQGISSYLAWYQQKPGKAPKLLIYAASNLLGGVPSR
FSGSGSGTDFTLTISSLQPEDFATYYCQQTYSTPWTFGQGTKVEIKRTVAAPSVFIFPPSDEQLKSGT
ASVVCLLNNFYPREAKVQWKVDNALQSGNSQESVTEQDSKDSTYSLSSTLTLSKADYEKHKVYACEV
THQGLSSPVTKSFNRGEC* (SEQ ID NO:143)

*MDMRVPAQLLGLLLLWLRGARC*DVQLVESGGGLVQPGGSLRLSCTSSANINSIETLGWYRQAPGKQ
RELIANMRGGGYMKYAGSLKGRFTMSTESAKNTMYLQMNSLKPEDTAVYYCYVKLRDDDYVYRGQ
GTQVTVSS<u>GGSGS</u>DIQMTQSPSSLSASVGDRVTITCRASQSISSYLNWYQQKPGKAPKLLIYAASSLQ
SGVPSRFSGSGSGTDFTLTISSLQPEDFATYYCQQSYSTPLTFGGGTKVEIKRTVAAPSVFIFPPSDEQ
LKSGTASVVCLLNNFYPREAKVQWKVDNALQSGNSQESVTEQDSKDSTYSLSSTLTLSKADYEKHKV
YACEVTHQGLSSPVTKSFNRGEC* (SEQ ID NO:144)

*MDMRVPAQLLGLLLLWLRGARC*DVQLVESGGGLVQAGGSLRLACAGSGRIFAIYDIAWYRHPPGNQ
RELVAMIRPVVTEIDYADSVKGRFTISRNNAMKTVYLQMNNLKPEDTAVYYCNAKRPWGSRDEYWG
QGTQVTVSS<u>GSGSG</u>DIQMTQSPSSLSASVGDRVTITCRASQSISSYLNWYQQKPGKAPKLLIYAASSL
QSGVPSRFSGSGSGTDFTLTISSLQPEDFATYYCQQSYSTPLTFGGGTKVEIKRTVAAPSVFIFPPSDE
QLKSGTASVVCLLNNFYPREAKVQWKVDNALQSGNSQESVTEQDSKDSTYSLSSTLTLSKADYEKHK
VYACEVTHQGLSSPVTKSFNRGEC* (SEQ ID NO:145)

FIG. 19 (contd.)

*MDMRVPAQLLGLLLLWLRGARC*QVKLEESGGGLVQAGGSLRLSCAASGRIFSIYDMGWFRQAPGK
EREFVSGIRWSGGTSYADSVKGRFTISKDNAKNTIYLQMNNLKAEDTAVYYCGSRGYWGQGTLVTV
SS<u>GGSGS</u>DIQMTQSPSSLSASVGDRVTITCRASQSISSYLNWYQQKPGKAPKLLIYAASSLQSGVPSR
FSGSGSGTDFTLTISSLQPEDFATYYCQQSYSTPLTFGGGTKVEIKRTVAAPSVFIFPPSDEQLKSGTA
SVVCLLNNFYPREAKVQWKVDNALQSGNSQESVTEQDSKDSTYSLSSTLTLSKADYEKHKVYACEVT
HQGLSSPVTKSFNRGEC* (SEQ ID NO:146)

*MDMRVPAQLLGLLLLWLRGARC*DVQLVESGGGLVQPGGSLRLSCTSSANINSIETLGWYRQAPGKQ
RELIANMRGGGYMKYAGSLKGRFTMSTESAKNTMYLQMNSLKPEDTAVYYCYVKLRDDDYVYRGQ
GTQVTVSS<u>GGSGS</u>DIQMTQSPSSLSASVGDRVTITCRASQSISSYLNWYQQKPGKAPKLLIYAASSLQ
SGVPSRFSGSGSGTDFTLTISSLQPEDFATYYCQQSYSTPLTFGGGTKVEIKRTVAAPSVFIFPPSDEQ
LKSGTASVVCLLNNFYPREAKVQWKVDNALQSGNSQESVTEQDSKDSTYSLSSTLTLSKADYEKHKV
YACEVTHQGLSSPVTKSFNRGEC* (SEQ ID NO:147)

*MDMRVPAQLLGLLLLWLRGARC*DVQLVESGGGLVQAGGSLRLACAGSGRIFAIYDIAWYRHPPGNQ
RELVAMIRPVVTEIDYADSVKGRFTISRNNAMKTVYLQMNNLKPEDTAVYYCNAKRPWGSRDEYWG
QGTQVTVSS<u>GGSGS</u>DIQMTQSPSSLSASVGDRVTITCRASQSISSYLNWYQQKPGKAPKLLIYAASSL
QSGVPSRFSGSGSGTDFTLTISSLQPEDFATYYCQQSYSTPLTFGGGTKVEIKRTVAAPSVFIFPPSDE
QLKSGTASVVCLLNNFYPREAKVQWKVDNALQSGNSQESVTEQDSKDSTYSLSSTLTLSKADYEKHK
VYACEVTHQGLSSPVTKSFNRGEC* (SEQ ID NO:148)

*MDMRVPAQLLGLLLLWLRGARC*QVKLEESGGGLVQAGGSLRLSCAASGRIFSIYDMGWFRQAPGK
EREFVSGIRWSGGTSYADSVKGRFTISKDNAKNTIYLQMNNLKAEDTAVYYCGSRGYWGQGTLVTV
SS<u>GGSGS</u>DIQMTQSPSSLSASVGDRVTITCRASQSISSYLNWYQQKPGKAPKLLIYAASSLQSGVPSR
FSGSGSGTDFTLTISSLQPEDFATYYCQQSYSTPLTFGGGTKVEIKRTVAAPSVFIFPPSDEQLKSGTA
SVVCLLNNFYPREAKVQWKVDNALQSGNSQESVTEQDSKDSTYSLSSTLTLSKADYEKHKVYACEVT
HQGLSSPVTKSFNRGEC* (SEQ ID NO:149)

*MDMRVPAQLLGLLLLWLRGARC*DVQLVESGGGLVQPGGSLRLSCTSSANINSIETLGWYRQAPGKQ
RELIANMRGGGYMKYAGSLKGRFTMSTESAKNTMYLQMNSLKPEDTAVYYCYVKLRDDDYVYRGQ
GTQVTVSS<u>GSGSG</u>DIQMTQSPSSLSASVGDRVTITCRASQSISSYLNWYQQKPGKAPKLLIYAASSLQ
SGVPSRFSGSGSGTDFTLTISSLQPEDFATYYCQQSYRTPFTFGPGTKVDIKRTVAAPSVFIFPPSDEQ
LKSGTASVVCLLNNFYPREAKVQWKVDNALQSGNSQESVTEQDSKDSTYSLSSTLTLSKADYEKHKV
YACEVTHQGLSSPVTKSFNRGEC* (SEQ ID NO:150)

*MDMRVPAQLLGLLLLWLRGARC*DVQLVESGGGLVQAGGSLRLACAGSGRIFAIYDIAWYRHPPGNQ
RELVAMIRPVVTEIDYADSVKGRFTISRNNAMKTVYLQMNNLKPEDTAVYYCNAKRPWGSRDEYWG
QGTQVTVSS<u>GSGSG</u>DIQMTQSPSSLSASVGDRVTITCRASQSISSYLNWYQQKPGKAPKLLIYAASSL
QSGVPSRFSGSGSGTDFTLTISSLQPEDFATYYCQQSYRTPFTFGPGTKVDIKRTVAAPSVFIFPPSDE
QLKSGTASVVCLLNNFYPREAKVQWKVDNALQSGNSQESVTEQDSKDSTYSLSSTLTLSKADYEKHK
VYACEVTHQGLSSPVTKSFNRGEC* (SEQ ID NO:151)

*MDMRVPAQLLGLLLLWLRGARC*QVKLEESGGGLVQAGGSLRLSCAASGRIFSIYDMGWFRQAPGK
EREFVSGIRWSGGTSYADSVKGRFTISKDNAKNTIYLQMNNLKAEDTAVYYCGSRGYWGQGTLVTV
SS<u>GSGSG</u>DIQMTQSPSSLSASVGDRVTITCRASQSISSYLNWYQQKPGKAPKLLIYAASSLQSGVPSR
FSGSGSGTDFTLTISSLQPEDFATYYCQQSYRTPFTFGPGTKVDIKRTVAAPSVFIFPPSDEQLKSGTA
SVVCLLNNFYPREAKVQWKVDNALQSGNSQESVTEQDSKDSTYSLSSTLTLSKADYEKHKVYACEVT
HQGLSSPVTKSFNRGEC* (SEQ ID NO:152)

*MDMRVPAQLLGLLLLWLRGARC*EVQLLQSGAEVKKPGSSVKVSCKASGGTFTYRYLHWVRQAPGQ
GLEWMGGIIPIFGTGNYAQKFQGRVTITADESTSTAYMELSSLRSEDTAVYYCASSMVRVPYYYGMD
VWGQGTLVTVSSASTKGPSVFPLAPSSKSTSGGTAALGCLVKDYFPEPVTVSWNSGALTSGVHTFPA
VLQSSGLYSLSSVVTVPSSSLGTQTYICNVNHKPSNTKVDKKVEPKSCDKTHTCPPCPAPEAAGGPS
VFLFPPKPKDTLMISRTPEVTCVVVDVSHEDPEVKFNWYVDGVEVHNAKTKPREEQYNSTYRVVSVL
TVLHQDWLNGKEYKCKVSNKALGAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNHYTQK
SLSLSPGK* (SEQ ID NO:153)

FIG. 19 (contd.)

*MDMRVPAQLLGLLLLWLRGARC*EVQLVESGGGLVKPGGSRLSCAASGFNFGIYSMTWVRQAPGK
GLEWISYISGDSGYTNYADSVKGRFTISRDDSKNTLYLQMNSLKTEDTAVYYCARVGPGGWFDPWG
QGTLVTVSSASTKGPSVFPLAPSSKSTSGGTAALGCLVKDYFPEPVTVSWNSGALTSGVHTFPAVLQ
SSGLYSLSSVVTVPSSSLGTQTYICNVNHKPSNTKVDKKVEPKSCDKTHTCPPCPAPEAAGGPSVFLF
PPKPKDTLMISRTPEVTCVVVDVSHEDPEVKFNWYVDGVEVHNAKTKPREEQYNSTYRVVSVLTVLH
QDWLNGKEYKCKVSNKALGAPIEKTISKAKGQPREPQVYTLPPSREEMTKNQVSLTCLVKGFYPSDIA
VEWESNGQPENNYKTTPPVLDSDGSFFLYSKLTVDKSRWQQGNVFSCSVMHEALHNHYTQKSLSLS
PGK* (SEQ ID NO:154)

*MDMRVPAQLLGLLLLWLRGARC*EVQLVESGGGLVKPGGSLRLSCAASGFTFTNYAMSWVRQAPGK
GLEWVSAISGSGGSTYYADSVKGRFTISRDDSKNTLYLQMNSLKTEDTAVYYCARATGFGTVVFDY
WGQGTLVTVSSASTKGPSVFPLAPSSKSTSGGTAALGCLVKDYFPEPVTVSWNSGALTSGVHTFPAV
LQSSGLYSLSSVVTVPSSSLGTQTYICNVNHKPSNTKVDKKVEPKSCDKTHTCPPCPAPEAAGGPSV
FLFPPKPKDTLMISRTPEVTCVVVDVSHEDPEVKFNWYVDGVEVHNAKTKPREEQYNSTYRVVSVLT
VLHQDWLNGKEYKCKVSNKALGAPIEKTISKAKGQPREPQVYTLPPSREEMTKNQVSLTCLVKGFYP
SDIAVEWESNGQPENNYKTTPPVLDSDGSFFLYSKLTVDKSRWQQGNVFSCSVMHEALHNHYTQKS
LSLSPGK* (SEQ ID NO:155)

*MDMRVPAQLLGLLLLWLRGARC*EVQLVQSGGGLVKPGGSLRLSCAASGFTFSSYSMNWVRQAPG
KGLEWVSYIENDGSITTYADSVKGRFTISRDDSKNTLYLQMNSLKTEDTAVYYCARAPYYYGSGSLF
RLDYWGQGTLVTVSSASTKGPSVFPLAPSSKSTSGGTAALGCLVKDYFPEPVTVSWNSGALTSGVH
TFPAVLQSSGLYSLSSVVTVPSSSLGTQTYICNVNHKPSNTKVDKKVEPKSCDKTHTCPPCPAPEAAG
GPSVFLFPPKPKDTLMISRTPEVTCVVVDVSHEDPEVKFNWYVDGVEVHNAKTKPREEQYNSTYRVV
SVLTVLHQDWLNGKEYKCKVSNKALGAPIEKTISKAKGQPREPQVYTLPPSREEMTKNQVSLTCLVKG
FYPSDIAVEWESNGQPENNYKTTPPVLDSDGSFFLYSKLTVDKSRWQQGNVFSCSVMHEALHNHYT
QKSLSLSPGK* (SEQ ID NO:156)

*MDMRVPAQLLGLLLLWLRGARC*QVQLVQSGAEVKKPGSSVKVSCKASGYTFTNNFMHWVRQAPG
QGLEWMGWINPNSGGTKYAQKFQGRVTITADESTSTAYMELSSLRSEDTAVYYCARSVGEVGATM
LGIGVWYWFDPWGQGTLVTVSSASTKGPSVFPLAPSSKSTSGGTAALGCLVKDYFPEPVTVSWNSG
ALTSGVHTFPAVLQSSGLYSLSSVVTVPSSSLGTQTYICNVNHKPSNTKVDKKVEPKSCDKTHTCPPC
PAPEAAGGPSVFLFPPKPKDTLMISRTPEVTCVVVDVSHEDPEVKFNWYVDGVEVHNAKTKPREEQY
NSTYRVVSVLTVLHQDWLNGKEYKCKVSNKALGAPIEKTISKAKGQPREPQVYTLPPSREEMTKNQV
SLTCLVKGFYPSDIAVEWESNGQPENNYKTTPPVLDSDGSFFLYSKLTVDKSRWQQGNVFSCSVMH
EALHNHYTQKSLSLSPGK* (SEQ ID NO:157)

*MDMRVPAQLLGLLLLWLRGARC*DVQLVESGGGLVQAGGSLRLACAGSGRIFAIYDIAWYRHPPGNQ
RELVAMIRPVVTEIDYADSVKGRFTISRNNAMKTVYLQMNNLKPEDTAVYYCNAKRPWGSRDEYWG
QGTQVTVSSDKTHTCPPCPAPEAAGGPSVFLFPPKPKDTLMISRTPEVTCVVVDVSHEDPEVKFNWY
VDGVEVHNAKTKPREEQYNSTYRVVSVLTVLHQDWLNGKEYKCKVSNKALGAPIEKTISKAKGQPRE
PQVYTLPPSREEMTKNQVSLSCAVKGFYPSDIAVEWESNGQPENNYKTTPPVLDSDGSFFLVSKLTV
DKSRWQQGNVFSCSVMHEALHNHYTQKSLSLSPGK<u>GGSGS</u>AVQQVESGGGLVQPGGSLRLSCAA
SGFTLDYYAISWFRQAPGKKRELVADITSGGSTNYADSVKGRFTISRDNAKNTIYLQMNSLKPEDTA
VYFCNAVTYNGYTIWGQGTQVTVSS<u>GSGSG</u>HHHHHH* (SEQ ID NO:2192)

*MDMRVPAQLLGLLLLWLRGARA*VQQVESGGGLVQPGGSLRLSCAASGFTLDYYAISWFRQAPGKK
RELVADITSGGSTNYADSVKGRFTISRDNAKNTIYLQMNSLKPEDTAVYFCNAVTYNGYTIWGQGTQ
VTVSSDKTHTCPPCPAPEAAGGPSVFLFPPKPKDTLMISRTPEVTCVVVDVSHEDPEVKFNWYVDGV
EVHNAKTKPREEQYNSTYRVVSVLTVLHQDWLNGKEYKCKVSNKALGAPIEKTISKAKGQPREPQVY
TLPPSREEMTKNQVSLWCLVKGFYPSDIAVEWESNGQPENNYKTTPPVLDSDGSFFLYSKLTVDKSR
WQQGNVFSCSVMHEALHNHYTQKSLSLSPGK<u>GGSGS</u>DVQLVESGGGLVQAGGSLRLACAGSGRIF
AIYDIAWYRHPPGNQRELVAMIRPVVTEIDYADSVKGRFTISRNNAMKTVYLQMNNLKPEDTAVYYC
NAKRPWGSRDEYWGQGTQVTVSS* (SEQ ID NO:2193)

FIG. 19 (contd.)

*MDMRVPAQLLGLLLLWLRGARC*DVQLVESGGGLVQAGGSLRLACAGSGRIFAIYDIAWYRHPPGNQ
RELVAMIRPVVTEIDYADSVKGRFTISRNNAMKTVYLQMNNLKPEDTAVYYCNAKRPWGSRDEYWG
QGTQVTVSS<u>GGSGS</u>AVQQVESGGGLVQPGGSLRLSCAASGFTLDYYAISWFRQAPGKKRELVADI
TSGGSTNYADSVKGRFTISRDNAKNTIYLQMNSLKPEDTAVYFCNAVTYNGYTIWGQGTQVTVSSDK
THTCPPCPAPEAAGGPSVFLFPPKPKDTLMISRTPEVTCVVVDVSHEDPEVKFNWYVDGVEVHNAKT
KPREEQYNSTYRVVSVLTVLHQDWLNGKEYKCKVSNKALGAPIEKTISKAKGQPREPQVYTLPPSRE
EMTKNQVSLTCLVKGFYPSDIAVEWESNGQPENNYKTTPPVLDSDGSFFLYSKLTVDKSRWQQGNV
FSCSVMHEALHNHYTQKSLSLSPGK* (SEQ ID NO:2194)

*MDMRVPAQLLGLLLLWLRGARC*DVQLVESGGGLVQAGGSLRLACAGSGRIFAIYDIAWYRHPPGNQ
RELVAMIRPVVTEIDYADSVKGRFTISRNNAMKTVYLQMNNLKPEDTAVYYCNAKRPWGSRDEYWG
QGTQVTVSS<u>GSSGSGGSGS</u>AVQQVESGGGLVQPGGSLRLSCAASGFTLDYYAISWFRQAPGKKR
ELVADITSGGSTNYADSVKGRFTISRDNAKNTIYLQMNSLKPEDTAVYFCNAVTYNGYTIWGQGTQV
TVSSDKTHTCPPCPAPEAAGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALGAPIEKTISKAKGQPREPQVYT
LPPSREEMTKNQVSLTCLVKGFYPSDIAVEWESNGQPENNYKTTPPVLDSDGSFFLYSKLTVDKSRW
QQGNVFSCSVMHEALHNHYTQKSLSLSPGK* (SEQ ID NO:2195)

*MDMRVPAQLLGLLLLWLRGARC*DVQLVESGGGLVQAGGSLRLACAGSGRIFAIYDIAWYRHPPGNQ
RELVAMIRPVVTEIDYADSVKGRFTISRNNAMKTVYLQMNNLKPEDTAVYYCNAKRPWGSRDEYWG
QGTQVTVSS<u>GSSGSGGGGSGGSGS</u>AVQQVESGGGLVQPGGSLRLSCAASGFTLDYYAISWFRQA
PGKKRELVADITSGGSTNYADSVKGRFTISRDNAKNTIYLQMNSLKPEDTAVYFCNAVTYNGYTIWG
QGTQVTVSSDKTHTCPPCPAPEAAGGPSVFLFPPKPKDTLMISRTPEVTCVVVDVSHEDPEVKFNWY
VDGVEVHNAKTKPREEQYNSTYRVVSVLTVLHQDWLNGKEYKCKVSNKALGAPIEKTISKAKGQPRE
PQVYTLPPSREEMTKNQVSLTCLVKGFYPSDIAVEWESNGQPENNYKTTPPVLDSDGSFFLYSKLTV
DKSRWQQGNVFSCSVMHEALHNHYTQKSLSLSPGK* (SEQ ID NO:2196)

*MDMRVPAQLLGLLLLWLRGARC*AVQQVESGGGLVQPGGSLRLSCAASGFTLDYYAISWFRQAPGK
KRELVADITSGGSTNYADSVKGRFTISRDNAKNTIYLQMNSLKPEDTAVYFCNAVTYNGYTIWGQGT
QVTVSSDKTHTCPPCPAPEAAGGPSVFLFPPKPKDTLMISRTPEVTCVVVDVSHEDPEVKFNWYVDG
VEVHNAKTKPREEQYNSTYRVVSVLTVLHQDWLNGKEYKCKVSNKALGAPIEKTISKAKGQPREPQV
YTLPPSREEMTKNQVSLTCLVKGFYPSDIAVEWESNGQPENNYKTTPPVLDSDGSFFLYSKLTVDKS
RWQQGNVFSCSVMHEALHNHYTQKSLSLSPGK<u>GGSGS</u>DVQLVESGGGLVQAGGSLRLACAGSGR
IFAIYDIAWYRHPPGNQRELVAMIRPVVTEIDYADSVKGRFTISRNNAMKTVYLQMNNLKPEDTAVYY
CNAKRPWGSRDEYWGQGTQVTVSS* (SEQ ID NO:2197)

*MDMRVPAQLLGLLLLWLRGARC*DVQLVESGGGLVQAGGSLRLACAGSGRIFAIYDIAWYRHPPGNQ
RELVAMIRPVVTEIDYADSVKGRFTISRNNAMKTVYLQMNNLKPEDTAVYYCNAKRPWGSRDEYWG
QGTQVTVSSDKTHTCPPCPAPEAAGGPSVFLFPPKPKDTLMISRTPEVTCVVVDVSHEDPEVKFNWY
VDGVEVHNAKTKPREEQYNSTYRVVSVLTVLHQDWLNGKEYKCKVSNKALGAPIEKTISKAKGQPRE
PQVYTLPPSREEMTKNQVSLWCLVKGFYPSDIAVEWESNGQPENNYKTTPPVLDSDGSFFLYSKLTV
DKSRWQQGNVFSCSVMHEALHNHYTQKSLSLSPGK<u>GGSGS</u>DVQLVESGGGLVQAGGSLRLACAG
SGRIFAIYDIAWYRHPPGNQRELVAMIRPVVTEIDYADSVKGRFTISRNNAMKTVYLQMNNLKPEDTA
VYYCNAKRPWGSRDEYWGQGTQVTVSS* (SEQ ID NO:2198)

*MDMRVPAQLLGLLLLWLRGARC*AVQQVESGGGLVQPGGSLRLSCAASGFTLDYYAISWFRQAPGK
KRELVADITSGGSTNYADSVKGRFTISRDNAKNTIYLQMNSLKPEDTAVYFCNAVTYNGYTIWGQGT
QVTVSSDKTHTCPPCPAPEAAGGPSVFLFPPKPKDTLMISRTPEVTCVVVDVSHEDPEVKFNWYVDG
VEVHNAKTKPREEQYNSTYRVVSVLTVLHQDWLNGKEYKCKVSNKALGAPIEKTISKAKGQPREPQV
YTLPPSREEMTKNQVSLSCAVKGFYPSDIAVEWESNGQPENNYKTTPPVLDSDGSFFLVSKLTVDKS
RWQQGNVFSCSVMHEALHNHYTQKSLSLSPGK<u>GGSGS</u>AVQQVESGGGLVQPGGSLRLSCAASGF
TLDYYAISWFRQAPGKKRELVADITSGGSTNYADSVKGRFTISRDNAKNTIYLQMNSLKPEDTAVYF
CNAVTYNGYTIWGQGTQVTVSS<u>GSGSG</u>HHHHHH* (SEQ ID NO:2199)

FIG. 19 (contd.)

*MDMRVPAQLLGLLLLWLRGARC*EVQLVESGGGLVQPGGSLRLSCAASGFTFSHYTLSWVRQAPGK
GLEWVSVISGDGSYTYYADSVKGRFTISSDNSKNTLYLQMNSLRAEDTAVYYCARNFIKYVFANWG
QGTLVTVSS<u>GGGGSGGGGSGGGGS</u>DIELTQPPSVSVAPGQTARISCSGDNIGSFYVHWYQQKPGQ
APVLVIYDKSNRPSGIPERFSGSNSGNTATLTISGTQAEDEADYYCQSYANTLSLVFGGGTKLTVL<u>G
SGSG</u>DVKLVESGGGLVKLGGSLRLSCAASGFSFSTSYMSWVRQTPEKRLELVAAINLNGGSTYYS
DTVKGRFTISRDNAKNTLYLQMSSLKSEDTAFYYCASELAGYGTPFAYWGQGTLVTVSA<u>GSAASGS
SGGSSSGA</u>DIVLTQSPATLSVTPGDSVSLSCKASQSISYNLHWYQQKSHESPRLLIKYTSQSISGIPS
RFSGSGSGTDFTLTINNVETEDFGMYFCQQSNSWPLTFGAGTKLEVK<u>GSGSG</u>DKTHTCPPCPAPEA
AGGPSVFLFPPKPKDTLMISRTPEVTCVVVDVSHEDPEVKFNWYVDGVEVHNAKTKPREEQYNSTYR
VVSVLTVLHQDWLNGKEYKCKVSNKALGAPIEKTISKAKGQPREPQVYTLPPSREEMTKNQVSLTCLV
KGFYPSDIAVEWESNGQPENNYKTTPPVLDSDGSFFLYSKLTVDKSRWQQGNVFSCSVMHEALHNH
YTQKSLSLSPGK* (SEQ ID NO:2200)

*MDMRVPAQLLGLLLLWLRGARC*EVQLVESGGGLVQPGGSLRLSCAASGFTFSHYTLSWVRQAPGK
GLEWVSVISGDGSYTYYADSVKGRFTISSDNSKNTLYLQMNSLRAEDTAVYYCARNFIKYVFANWG
QGTLVTVSS<u>GGGGSGGGGSGGGGS</u>DIELTQPPSVSVAPGQTARISCSGDNIGSFYVHWYQQKPGQ
APVLVIYDKSNRPSGIPERFSGSNSGNTATLTISGTQAEDEADYYCQSYANTLSLVFGGGTKLTVL<u>G
SGSGGSGSG</u>DVKLVESGGGLVKLGGSLRLSCAASGFSFSTSYMSWVRQTPEKRLELVAAINLNGG
STYYSDTVKGRFTISRDNAKNTLYLQMSSLKSEDTAFYYCASELAGYGTPFAYWGQGTLVTVSA<u>GS
AASGSSGGSSSGA</u>DIVLTQSPATLSVTPGDSVSLSCKASQSISYNLHWYQQKSHESPRLLIKYTSQSI
SGIPSRFSGSGSGTDFTLTINNVETEDFGMYFCQQSNSWPLTFGAGTKLEVK<u>GSGSG</u>DKTHTCPPC
PAPEAAGGPSVFLFPPKPKDTLMISRTPEVTCVVVDVSHEDPEVKFNWYVDGVEVHNAKTKPREEQY
NSTYRVVSVLTVLHQDWLNGKEYKCKVSNKALGAPIEKTISKAKGQPREPQVYTLPPSREEMTKNQV
SLTCLVKGFYPSDIAVEWESNGQPENNYKTTPPVLDSDGSFFLYSKLTVDKSRWQQGNVFSCSVMH
EALHNHYTQKSLSLSPGK* (SEQ ID NO:2201)

*MDMRVPAQLLGLLLLWLRGARC*EVQLVESGGGLVQPGGSLRLSCAASGFTFSHYTLSWVRQAPGK
GLEWVSVISGDGSYTYYADSVKGRFTISSDNSKNTLYLQMNSLRAEDTAVYYCARNFIKYVFANWG
QGTLVTVSS<u>GGGGSGGGGSGGGGS</u>DIELTQPPSVSVAPGQTARISCSGDNIGSFYVHWYQQKPGQ
APVLVIYDKSNRPSGIPERFSGSNSGNTATLTISGTQAEDEADYYCQSYANTLSLVFGGGTKLTVL<u>G
SGSGGSGSGGSSGG</u>DVKLVESGGGLVKLGGSLRLSCAASGFSFSTSYMSWVRQTPEKRLELVAAI
NLNGGSTYYSDTVKGRFTISRDNAKNTLYLQMSSLKSEDTAFYYCASELAGYGTPFAYWGQGTLVT
VSA<u>GSAASGSSGGSSSGA</u>DIVLTQSPATLSVTPGDSVSLSCKASQSISYNLHWYQQKSHESPRLLIK
YTSQSISGIPSRFSGSGSGTDFTLTINNVETEDFGMYFCQQSNSWPLTFGAGTKLEVK<u>GSGSG</u>DKTH
TCPPCPAPEAAGGPSVFLFPPKPKDTLMISRTPEVTCVVVDVSHEDPEVKFNWYVDGVEVHNAKTKP
REEQYNSTYRVVSVLTVLHQDWLNGKEYKCKVSNKALGAPIEKTISKAKGQPREPQVYTLPPSREEM
TKNQVSLTCLVKGFYPSDIAVEWESNGQPENNYKTTPPVLDSDGSFFLYSKLTVDKSRWQQGNVFSC
SVMHEALHNHYTQKSLSLSPGK* (SEQ ID NO:2202)

*MDMRVPAQLLGLLLLWLRGARC*DVKLVESGGGLVKLGGSLRLSCAASGFSFSTSYMSWVRQTPEK
RLELVAAINLNGGSTYYSDTVKGRFTISRDNAKNTLYLQMSSLKSEDTAFYYCASELAGYGTPFAYW
GQGTLVTVSA<u>GSAASGSSGGSSSGA</u>DIVLTQSPATLSVTPGDSVSLSCKASQSISYNLHWYQQKSH
ESPRLLIKYTSQSISGIPSRFSGSGSGTDFTLTINNVETEDFGMYFCQQSNSWPLTFGAGTKLEVK<u>GS
GSG</u>EVQLVESGGGLVQPGGSLRLSCAASGFTFSHYTLSWVRQAPGKGLEWVSVISGDGSYTYYAD
SVKGRFTISSDNSKNTLYLQMNSLRAEDTAVYYCARNFIKYVFANWGQGTLVTVSS<u>GGGGSGGGG
SGGGGS</u>DIELTQPPSVSVAPGQTARISCSGDNIGSFYVHWYQQKPGQAPVLVIYDKSNRPSGIPERF
SGSNSGNTATLTISGTQAEDEADYYCQSYANTLSLVFGGGTKLTVL<u>GSGSG</u>DKTHTCPPCPAPEAA
GGPSVFLFPPKPKDTLMISRTPEVTCVVVDVSHEDPEVKFNWYVDGVEVHNAKTKPREEQYNSTYRV
VSVLTVLHQDWLNGKEYKCKVSNKALGAPIEKTISKAKGQPREPQVYTLPPSREEMTKNQVSLTCLVK
GFYPSDIAVEWESNGQPENNYKTTPPVLDSDGSFFLYSKLTVDKSRWQQGNVFSCSVMHEALHNHY
TQKSLSLSPGK* (SEQ ID NO:2203)

FIG. 19 (contd.)

*MDMRVPAQLLGLLLLWLRGARC*DVKLVESGGGLVKLGGSLRLSCAASGFSFSTSYMSWVRQTPEK
RLELVAAINLNGGSTYYSDTVKGRFTISRDNAKNTLYLQMSSLKSEDTAFYYCASELAGYGTPFAYW
GQGTLVTVSA<u>GSAASGSSGGSSSGA</u>DIVLTQSPATLSVTPGDSVSLSCKASQSISYNLHWYQQKSH
ESPRLLIKYTSQSISGIPSRFSGSGSGTDFTLTINNVETEDFGMYFCQQSNSWPLTFGAGTKLEVK<u>GS
GSGGSGSG</u>EVQLVESGGGLVQPGGSLRLSCAASGFTFSHYTLSWVRQAPGKGLEWVSVISGDGS
YTYYADSVKGRFTISSDNSKNTLYLQMNSLRAEDTAVYYCARNFIKYVFANWGQGTLVTVSS<u>GGGG
SGGGGSGGGGS</u>DIELTQPPSVSVAPGQTARISCSGDNIGSFYVHWYQQKPGQAPVLVIYDKSNRPS
GIPERFSGSNSGNTATLTISGTQAEDEADYYCQSYANTLSLVFGGGTKLTVL<u>GSGSG</u>DKTHTCPPCP
APEAAGGPSVFLFPPKPKDTLMISRTPEVTCVVVDVSHEDPEVKFNWYVDGVEVHNAKTKPREEQYN
STYRVVSVLTVLHQDWLNGKEYKCKVSNKALGAPIEKTISKAKGQPREPQVYTLPPSREEMTKNQVSL
TCLVKGFYPSDIAVEWESNGQPENNYKTTPPVLDSDGSFFLYSKLTVDKSRWQQGNVFSCSVMHEA
LHNHYTQKSLSLSPGK* (SEQ ID NO:2204)

*MDMRVPAQLLGLLLLWLRGARC*DVKLVESGGGLVKLGGSLRLSCAASGFSFSTSYMSWVRQTPEK
RLELVAAINLNGGSTYYSDTVKGRFTISRDNAKNTLYLQMSSLKSEDTAFYYCASELAGYGTPFAYW
GQGTLVTVSA<u>GSAASGSSGGSSSGA</u>DIVLTQSPATLSVTPGDSVSLSCKASQSISYNLHWYQQKSH
ESPRLLIKYTSQSISGIPSRFSGSGSGTDFTLTINNVETEDFGMYFCQQSNSWPLTFGAGTKLEVK<u>GS
GSGGSGSGGSSGG</u>EVQLVESGGGLVQPGGSLRLSCAASGFTFSHYTLSWVRQAPGKGLEWVSVI
SGDGSYTYYADSVKGRFTISSDNSKNTLYLQMNSLRAEDTAVYYCARNFIKYVFANWGQGTLVTVS
S<u>GGGGSGGGGSGGGGS</u>DIELTQPPSVSVAPGQTARISCSGDNIGSFYVHWYQQKPGQAPVLVIYD
KSNRPSGIPERFSGSNSGNTATLTISGTQAEDEADYYCQSYANTLSLVFGGGTKLTVL<u>GSGSG</u>DKTH
TCPPCPAPEAAGGPSVFLFPPKPKDTLMISRTPEVTCVVVDVSHEDPEVKFNWYVDGVEVHNAKTKP
REEQYNSTYRVVSVLTVLHQDWLNGKEYKCKVSNKALGAPIEKTISKAKGQPREPQVYTLPPSREEM
TKNQVSLTCLVKGFYPSDIAVEWESNGQPENNYKTTPPVLDSDGSFFLYSKLTVDKSRWQQGNVFSC
SVMHEALHNHYTQKSLSLSPGK* (SEQ ID NO:2205)

*MDMRVPAQLLGLLLLWLRGARC*EVQLVESGGGLVQPGGSLRLSCAASGFTFSHYTLSWVRQAPGK
GLEWVSVISGDGSYTYYADSVKGRFTISSDNSKNTLYLQMNSLRAEDTAVYYCARNFIKYVFANWG
QGTLVTVSS<u>GGGGSGGGGSGGGGS</u>DIELTQPPSVSVAPGQTARISCSGDNIGSFYVHWYQQKPGQ
APVLVIYDKSNRPSGIPERFSGSNSGNTATLTISGTQAEDEADYYCQSYANTLSLVFGGGTKLTVL<u>G
SGSG</u>EVQLVESGGGLVQPGGSLRLSCAASGFTFTSYYISWVRQAPGKGLEWVAEISPYSGSTYYAD
SVKGRFTISADTSKNTAYLQMNSLRAEDTAVYYCALRARPPIRLHPRGSVMDYWGQGTLVTVSS<u>GS
AASGSSGGSSSGA</u>DIQMTQSPSSLSASVGDRVTITCRASQDVSTAVAWYQQKPGKAPKLLIYSASF
LYSGVPSRFSGSGSGTDFTLTISSLQPEDFATYYCQQSYTTPPTFGQGTKVEIK<u>GSGSG</u>DKTHTCPP
CPAPEAAGGPSVFLFPPKPKDTLMISRTPEVTCVVVDVSHEDPEVKFNWYVDGVEVHNAKTKPREEQ
YNSTYRVVSVLTVLHQDWLNGKEYKCKVSNKALGAPIEKTISKAKGQPREPQVYTLPPSREEMTKNQ
VSLTCLVKGFYPSDIAVEWESNGQPENNYKTTPPVLDSDGSFFLYSKLTVDKSRWQQGNVFSCSVM
HEALHNHYTQKSLSLSPGK* (SEQ ID NO:2206)

*MDMRVPAQLLGLLLLWLRGARC*EVQLVESGGGLVQPGGSLRLSCAASGFTFSHYTLSWVRQAPGK
GLEWVSVISGDGSYTYYADSVKGRFTISSDNSKNTLYLQMNSLRAEDTAVYYCARNFIKYVFANWG
QGTLVTVSS<u>GGGGSGGGGSGGGGS</u>DIELTQPPSVSVAPGQTARISCSGDNIGSFYVHWYQQKPGQ
APVLVIYDKSNRPSGIPERFSGSNSGNTATLTISGTQAEDEADYYCQSYANTLSLVFGGGTKLTVL<u>G
SGSGGSGSG</u>EVQLVESGGGLVQPGGSLRLSCAASGFTFTSYYISWVRQAPGKGLEWVAEISPYSG
STYYADSVKGRFTISADTSKNTAYLQMNSLRAEDTAVYYCALRARPPIRLHPRGSVMDYWGQGTLV
TVSS<u>GSAASGSSGGSSSGA</u>DIQMTQSPSSLSASVGDRVTITCRASQDVSTAVAWYQQKPGKAPKLL
IYSASFLYSGVPSRFSGSGSGTDFTLTISSLQPEDFATYYCQQSYTTPPTFGQGTKVEIK<u>GSGSG</u>DKT
HTCPPCPAPEAAGGPSVFLFPPKPKDTLMISRTPEVTCVVVDVSHEDPEVKFNWYVDGVEVHNAKTK
PREEQYNSTYRVVSVLTVLHQDWLNGKEYKCKVSNKALGAPIEKTISKAKGQPREPQVYTLPPSREE
MTKNQVSLTCLVKGFYPSDIAVEWESNGQPENNYKTTPPVLDSDGSFFLYSKLTVDKSRWQQGNVF
SCSVMHEALHNHYTQKSLSLSPGK* (SEQ ID NO:2207)

FIG. 19 (contd.)

*MDMRVPAQLLGLLLLWLRGAR*CEVQLVESGGGLVQPGGSLRLSCAASGFTFSHYTLSWVRQAPGK
GLEWVSVISGDGSYTYYADSVKGRFTISSDNSKNTLYLQMNSLRAEDTAVYYCARNFIKYVFANWG
QGTLVTVSS<u>GGGGSGGGGSGGGGS</u>DIELTQPPSVSVAPGQTARISCSGDNIGSFYVHWYQQKPGQ
APVLVIYDKSNRPSGIPERFSGSNSGNTATLTISGTQAEDEADYYCQSYANTLSLVFGGGTKLTVL<u>G</u>
<u>SGSGGGSGSGGSSGG</u>EVQLVESGGGLVQPGGSLRLSCAASGFTFTSYYISWVRQAPGKGLEWVAEI
SPYSGSTYYADSVKGRFTISADTSKNTAYLQMNSLRAEDTAVYYCALRARPPIRLHPRGSVMDYWG
QGTLVTVSS<u>GSAASGSSGGSSSGA</u>DIQMTQSPSSLSASVGDRVTITCRASQDVSTAVAWYQQKPG
KAPKLLIYSASFLYSGVPSRFSGSGSGTDFTLTISSLQPEDFATYYCQQSYTTPPTFGQGTKVEIK<u>GS</u>
<u>GSG</u>DKTHTCPPCPAPEAAGGPSVFLFPPKPKDTLMISRTPEVTCVVVDVSHEDPEVKFNWYVDGVEV
HNAKTKPREEQYNSTYRVVSVLTVLHQDWLNGKEYKCKVSNKALGAPIEKTISKAKGQPREPQVYTL
PPSREEMTKNQVSLTCLVKGFYPSDIAVEWESNGQPENNYKTTPPVLDSDGSFFLYSKLTVDKSRWQ
QGNVFSCSVMHEALHNHYTQKSLSLSPGK* (SEQ ID NO:2208)

*MDMRVPAQLLGLLLLWLRGAR*CEVQLVESGGGLVQPGGSLRLSCAASGFTFTSYYISWVRQAPGK
GLEWVAEISPYSGSTYYADSVKGRFTISADTSKNTAYLQMNSLRAEDTAVYYCALRARPPIRLHPRG
SVMDYWGQGTLVTVSS<u>GSAASGSSGGSSSGA</u>DIQMTQSPSSLSASVGDRVTITCRASQDVSTAVA
WYQQKPGKAPKLLIYSASFLYSGVPSRFSGSGSGTDFTLTISSLQPEDFATYYCQQSYTTPPTFGQG
TKVEIK<u>GSGSG</u>EVQLVESGGGLVQPGGSLRLSCAASGFTFSHYTLSWVRQAPGKGLEWVSVISGD
GSYTYYADSVKGRFTISSDNSKNTLYLQMNSLRAEDTAVYYCARNFIKYVFANWGQGTLVTVSS<u>GG</u>
<u>GGSGGGGSGGGGS</u>DIELTQPPSVSVAPGQTARISCSGDNIGSFYVHWYQQKPGQAPVLVIYDKSNR
PSGIPERFSGSNSGNTATLTISGTQAEDEADYYCQSYANTLSLVFGGGTKLTVL<u>GSGSG</u>DKTHTCPP
CPAPEAAGGPSVFLFPPKPKDTLMISRTPEVTCVVVDVSHEDPEVKFNWYVDGVEVHNAKTKPREEQ
YNSTYRVVSVLTVLHQDWLNGKEYKCKVSNKALGAPIEKTISKAKGQPREPQVYTLPPSREEMTKNQ
VSLTCLVKGFYPSDIAVEWESNGQPENNYKTTPPVLDSDGSFFLYSKLTVDKSRWQQGNVFSCSVM
HEALHNHYTQKSLSLSPGK* (SEQ ID NO:2209)

*MDMRVPAQLLGLLLLWLRGAR*CEVQLVESGGGLVQPGGSLRLSCAASGFTFTSYYISWVRQAPGK
GLEWVAEISPYSGSTYYADSVKGRFTISADTSKNTAYLQMNSLRAEDTAVYYCALRARPPIRLHPRG
SVMDYWGQGTLVTVSS<u>GSAASGSSGGSSSGA</u>DIQMTQSPSSLSASVGDRVTITCRASQDVSTAVA
WYQQKPGKAPKLLIYSASFLYSGVPSRFSGSGSGTDFTLTISSLQPEDFATYYCQQSYTTPPTFGQG
TKVEIK<u>GSGSGGSGSG</u>EVQLVESGGGLVQPGGSLRLSCAASGFTFSHYTLSWVRQAPGKGLEWVS
VISGDGSYTYYADSVKGRFTISSDNSKNTLYLQMNSLRAEDTAVYYCARNFIKYVFANWGQGTLVTV
SS<u>GGGGSGGGGSGGGGS</u>DIELTQPPSVSVAPGQTARISCSGDNIGSFYVHWYQQKPGQAPVLVIY
DKSNRPSGIPERFSGSNSGNTATLTISGTQAEDEADYYCQSYANTLSLVFGGGTKLTVL<u>GSGSG</u>DKT
HTCPPCPAPEAAGGPSVFLFPPKPKDTLMISRTPEVTCVVVDVSHEDPEVKFNWYVDGVEVHNAKTK
PREEQYNSTYRVVSVLTVLHQDWLNGKEYKCKVSNKALGAPIEKTISKAKGQPREPQVYTLPPSREE
MTKNQVSLTCLVKGFYPSDIAVEWESNGQPENNYKTTPPVLDSDGSFFLYSKLTVDKSRWQQGNVF
SCSVMHEALHNHYTQKSLSLSPGK* (SEQ ID NO:2210)

*MDMRVPAQLLGLLLLWLRGAR*CEVQLVESGGGLVQPGGSLRLSCAASGFTFTSYYISWVRQAPGK
GLEWVAEISPYSGSTYYADSVKGRFTISADTSKNTAYLQMNSLRAEDTAVYYCALRARPPIRLHPRG
SVMDYWGQGTLVTVSS<u>GSAASGSSGGSSSGA</u>DIQMTQSPSSLSASVGDRVTITCRASQDVSTAVA
WYQQKPGKAPKLLIYSASFLYSGVPSRFSGSGSGTDFTLTISSLQPEDFATYYCQQSYTTPPTFGQG
TKVEIK<u>GSGSGGSGSGGSSGG</u>EVQLVESGGGLVQPGGSLRLSCAASGFTFSHYTLSWVRQAPGK
GLEWVSVISGDGSYTYYADSVKGRFTISSDNSKNTLYLQMNSLRAEDTAVYYCARNFIKYVFANWG
QGTLVTVSS<u>GGGGSGGGGSGGGGS</u>DIELTQPPSVSVAPGQTARISCSGDNIGSFYVHWYQQKPGQ
APVLVIYDKSNRPSGIPERFSGSNSGNTATLTISGTQAEDEADYYCQSYANTLSLVFGGGTKLTVL<u>G</u>
<u>SGSG</u>DKTHTCPPCPAPEAAGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALGAPIEKTISKAKGQPREPQVYT
LPPSREEMTKNQVSLTCLVKGFYPSDIAVEWESNGQPENNYKTTPPVLDSDGSFFLYSKLTVDKSRW
QQGNVFSCSVMHEALHNHYTQKSLSLSPGK* (SEQ ID NO:2211)

FIG. 19 (contd.)

*MDMRVPAQLLGLLLLWLRGARC*EVQLVESGGGLVQPGGSLRLSCAASGFTFSHYTLSWVRQAPGK
GLEWVSVISGDGSYTYYADSVKGRFTISSDNSKNTLYLQMNSLRAEDTAVYYCARNFIKYVFANWG
QGTLVTVSS<u>GGGGSGGGGSGGGGS</u>DIELTQPPSVSVAPGQTARISCSGDNIGSFYVHWYQQKPGQ
APVLVIYDKSNRPSGIPERFSGSNSGNTATLTISGTQAEDEADYYCQSYANTLSLVFGGGTKLTVL<u>G
SGSG</u>DKTHTCPPCPAPEAAGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALGAPIEKTISKAKGQPREPQVYT
LPPSREEMTKNQVSLTCLVKGFYPSDIAVEWESNGQPENNYKTTPPVLDSDGSFFLYSKLTVDKSRW
QQGNVFSCSVMHEALHNHYTQKSLSLSPGK<u>GSGSG</u>DVKLVESGGGLVKLGGSLRLSCAASGFSFS
TSYMSWVRQTPEKRLELVAAINLNGGSTYYSDTVKGRFTISRDNAKNTLYLQMSSLKSEDTAFYYC
ASELAGYGTPFAYWGQGTLVTVSA<u>GSAASGSSGGSSSGA</u>DIVLTQSPATLSVTPGDSVSLSCKASQ
SISYNLHWYQQKSHESPRLLIKYTSQSISGIPSRFSGSGSGTDFTLTINNVETEDFGMYFCQQSNSWP
LTFGAGTKLEVK* (SEQ ID NO:2212)

*MDMRVPAQLLGLLLLWLRGARC*DVKLVESGGGLVKLGGSLRLSCAASGFSFSTSYMSWVRQTPEK
RLELVAAINLNGGSTYYSDTVKGRFTISRDNAKNTLYLQMSSLKSEDTAFYYCASELAGYGTPFAYW
GQGTLVTVSA<u>GSAASGSSGGSSSGA</u>DIVLTQSPATLSVTPGDSVSLSCKASQSISYNLHWYQQKSH
ESPRLLIKYTSQSISGIPSRFSGSGSGTDFTLTINNVETEDFGMYFCQQSNSWPLTFGAGTKLEVK<u>GS
GSG</u>DKTHTCPPCPAPEAAGGPSVFLFPPKPKDTLMISRTPEVTCVVVDVSHEDPEVKFNWYVDGVEV
HNAKTKPREEQYNSTYRVVSVLTVLHQDWLNGKEYKCKVSNKALGAPIEKTISKAKGQPREPQVYTL
PPSREEMTKNQVSLTCLVKGFYPSDIAVEWESNGQPENNYKTTPPVLDSDGSFFLYSKLTVDKSRWQ
QGNVFSCSVMHEALHNHYTQKSLSLSPGK<u>GSGSG</u>EVQLVESGGGLVQPGGSLRLSCAASGFTFSH
YTLSWVRQAPGKGLEWVSVISGDGSYTYYADSVKGRFTISSDNSKNTLYLQMNSLRAEDTAVYYCA
RNFIKYVFANWGQGTLVTVSS<u>GGGGSGGGGSGGGGS</u>DIELTQPPSVSVAPGQTARISCSGDNIGSF
YVHWYQQKPGQAPVLVIYDKSNRPSGIPERFSGSNSGNTATLTISGTQAEDEADYYCQSYANTLSLV
FGGGTKLTVL* (SEQ ID NO:2213)

*MDMRVPAQLLGLLLLWLRGARC*QAVVLQEPSLSVSPGGTVTLTCGLSSGSVSTNYYPSWYQDTPG
QDPRTLIYYTNTRSSDVPERFSGSIVGNKAALTITGAQPDDESVYFCLLYLGRGIWVFGGGTKLTVLG
QPKAAPSVTLFPPSSEELQANKATLVCLISDFYPGAVTVAWKADSSPVKAGVETTTPSKQSNNKYAAK
SYLSLTPEQWKSHRSYSCQVTHEGSTVEKTVAPTECS* (SEQ ID NO:2214)

*MDMRVPAQLLGLLLLWLRGARC*QIVLTQSPAIMSASPGEKVTISCSANSSVRFMFWYQKKPGSKPK
PLIYRTSNLASGVPARFSGSGSGTSYSLTISSMEAEDAATYYCQQYHSYPWTFGGGTKLEIKRTVAA
PSVFIFPPSDEQLKSGTASVVCLLNNFYPREAKVQWKVDNALQSGNSQESVTEQDSKDSTYSLESTL
TLSKADYEKHKVYACEVTHQGLSSPVTKSFNRGEC* (SEQ ID NO:2215)

*MDMRVPAQLLGLLLLWLRGARC*QVQLQQSGPELVKPGASVRISCKASGYTFTTYYIHWLKDRPGQG
LEWIGWIFPGNVNTKYNAKFKGKATLTADKSSSTAYMQLSSLTSEDSAVYFCAREELQYYFDYWGD
GSTLTVSSASTKGPSVFPLAPSSKSTSGGTAALGCLVKDYFPEPVTVSWNSGALTSGVHTFPAVLQS
SGLYSLKSVVTVPSSSLGTQTYICNVNHKPSNTKVDKKVEPKSC<u>GSGSG</u>EVQLVQSGAEVKKPGAS
VKVSCKASGYTFTSYGISWVRKAPGQGLEWMGWISAYNGNTNYAQKLQGRVTMTTDTSTSTAYME
LRSLRSDDTAVYYCASSKEKATYYYGMDVWGKGTTVTVSSASTKGPSVFPLAPSSKSTSGGTAALG
CLVKDYFPEPVTVSWNSGALTSGVHTFPAVLQSSGLYSLESVVTVPSSSLGTQTYICNVNHKPSNTKV
DKKVEPKSCDKTHTCPPCPAPEAAGGPSVFLFPPKPKDTLMISRTPEVTCVVVDVSHEDPEVKFNWY
VDGVEVHNAKTKPREEQYNSTYRVVSVLTVLHQDWLNGKEYKCKVSNKALGAPIEKTISKAKGQPRE
PQVYTLPPSREEMTKNQVSLTCLVKGFYPSDIAVEWESNGQPENNYKTTPPVLDSDGSFFLYSKLTV
DKSRWQQGNVFSCSVMHEALHNHYTQKSLSLSPGK* (SEQ ID NO:2216)

*MDMRVPAQLLGLLLLWLRGARC*SYVLTQPPSVSVSPGQTASITCSGDKVGHKYASWYQDKPGQDP
VLVIYEDSQRPSGIPVRFSGSNSGNTATLTISGTQAMDEADYYCQAWDSSTDVVFGGGTKLTVLGQ
PKAAPSVTLFPPSSEELQANKATLVCLISDFYPGAVTVAWKADSSPVKAGVETTTPSKQSNNKYAAKS
YLSLTPEQWKSHRSYSCQVTHEGSTVEKTVAPTECS* (SEQ ID NO:2217)

*MDMRVPAQLLGLLLLWLRGARC*DIQMTQSPSSLSASVGDRVTITCRASQSISSYLNWYQKKPGKKP
KLLIYAASSLQSGVPSRFSGSGSGTDFTLTISSLQPEDFATYYCQQSYSTPLTFGGGTKVEIKRTVAA
PSVFIFPPSDEQLKSGTASVVCLLNNFYPREAKVQWKVDNALQSGNSQESVTEQDSKDSTYSLESTL
TLSKADYEKHKVYACEVTHQGLSSPVTKSFNRGEC* (SEQ ID NO:2218)

FIG. 19 (contd.)

*MDMRVPAQLLGLLLLWLRGARC*QVQLQQWGAGLLKPSETLSLTCAVSGASFSGHYWTWIRKPPGK
GLEWIGEIDHTGSTNYEPSLRSRVTISVDTSKNQFSLNLKSVTAADTAVYYCARGGQGGYDWGHYH
GLDVWGKGTTVTVSSASTKGPSVFPLAPSSKSTSGGTAALGCLVKDYFPEPVTVSWNSGALTSGVH
TFPAVLQSSGLYSLESVVTVPSSSLGTQTYICNVNHKPSNTKVDKKVEPKSC<u>GSGSG</u>EVQLVESGGG
LVQPGGSLRLSCAASGFTFSSYAMHWVRDAPGKGLEWVASISSTSGSKYYADSVKGRFTISRDNS
KNTLYLQMNSLRAEDTAVYSCAKTYYDFWSGYYTFDYWGDGTLVTVSSASTKGPSVFPLAPSSKST
SGGTAALGCLVKDYFPEPVTVSWNSGALTSGVHTFPAVLQSSGLYSLKSVVTVPSSSLGTQTYICNVN
HKPSNTKVDKKVEPKSCDKTHTCPPCPAPEAAGGPSVFLFPPKPKDTLMISRTPEVTCVVVDVSHED
PEVKFNWYVDGVEVHNAKTKPREEQYNSTYRVVSVLTVLHQDWLNGKEYKCKVSNKALGAPIEKTIS
KAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGK* (SEQ ID NO:2219)

*MDMRVPAQLLGLLLLWLRGARC*SYVLTQPPSVSVSPGQTASITCSGDKVGHKYASWYQDKPGQDP
VLVIYEDSQRPSGIPVRFSGSNSGNTATLTISGTQAMDEADYYCQAWDSSTDVVFGGGTKLTVLGQ
PKAAPSVTLFPPSSEELQANKATLVCLISDFYPGAVTVAWKADSSPVKAGVETTTPSKQSNNKYAAKS
YLSLTPEQWKSHRSYSCQVTHEGSTVEKTVAPTECS* (SEQ ID NO:2220)

*MDMRVPAQLLGLLLLWLRGARC*DIQMTQSPSSLSASVGDRVTITCRASQSISSYLNWYQKKPGKKP
KLLIYAASSLQSGVPSRFSGSGSGTDFTLTISSLQPEDFATYYCQQSYSTPLTFGGGTKVEIKRTVAA
PSVFIFPPSDEQLKSGTASVVCLLNNFYPREAKVQWKVDNALQSGNSQESVTEQDSKDSTYSLESTL
TLSKADYEKHKVYACEVTHQGLSSPVTKSFNRGEC* (SEQ ID NO:2221)

*MDMRVPAQLLGLLLLWLRGARC*QVQLQQWGAGLLKPSETLSLTCAVSGASFSGHYWTWIRKPPGK
GLEWIGEIDHTGSTNYEPSLRSRVTISVDTSKNQFSLNLKSVTAADTAVYYCARGGQGGYDWGHYH
GLDVWGKGTTVTVSSASTKGPSVFPLAPSSKSTSGGTAALGCLVKDYFPEPVTVSWNSGALTSGVH
TFPAVLQSSGLYSLESVVTVPSSSLGTQTYICNVNHKPSNTKVDKKVEPKSC<u>GSGSGGSGSG</u>EVQLV
ESGGGLVQPGGSLRLSCAASGFTFSSYAMHWVRDAPGKGLEWVASISSTSGSKYYADSVKGRFTI
SRDNSKNTLYLQMNSLRAEDTAVYSCAKTYYDFWSGYYTFDYWGDGTLVTVSSASTKGPSVFPLAP
SSKSTSGGTAALGCLVKDYFPEPVTVSWNSGALTSGVHTFPAVLQSSGLYSLKSVVTVPSSSLGTQT
YICNVNHKPSNTKVDKKVEPKSCDKTHTCPPCPAPEAAGGPSVFLFPPKPKDTLMISRTPEVTCVVVD
VSHEDPEVKFNWYVDGVEVHNAKTKPREEQYNSTYRVVSVLTVLHQDWLNGKEYKCKVSNKALGAP
IEKTISKAKGQPREPQVYTLPPSREEMTKNQVSLTCLVKGFYPSDIAVEWESNGQPENNYKTTPPVLD
SDGSFFLYSKLTVDKSRWQQGNVFSCSVMHEALHNHYTQKSLSLSPGK* (SEQ ID NO:2222)

*MDMRVPAQLLGLLLLWLRGARC*SYVLTQPPSVSVSPGQTASITCSGDKVGHKYASWYQDKPGQDP
VLVIYEDSQRPSGIPVRFSGSNSGNTATLTISGTQAMDEADYYCQAWDSSTDVVFGGGTKLTVLGQ
PKAAPSVTLFPPSSEELQANKATLVCLISDFYPGAVTVAWKADSSPVKAGVETTTPSKQSNNKYAAKS
YLSLTPEQWKSHRSYSCQVTHEGSTVEKTVAPTECS* (SEQ ID NO:2223)

*MDMRVPAQLLGLLLLWLRGARC*DIQMTQSPSSLSASVGDRVTITCRASQSISSYLNWYQKKPGKKP
KLLIYAASSLQSGVPSRFSGSGSGTDFTLTISSLQPEDFATYYCQQSYSTPLTFGGGTKVEIKRTVAA
PSVFIFPPSDEQLKSGTASVVCLLNNFYPREAKVQWKVDNALQSGNSQESVTEQDSKDSTYSLESTL
TLSKADYEKHKVYACEVTHQGLSSPVTKSFNRGEC* (SEQ ID NO:2224)

*MDMRVPAQLLGLLLLWLRGARC*QVQLQQWGAGLLKPSETLSLTCAVSGASFSGHYWTWIRKPPGK
GLEWIGEIDHTGSTNYEPSLRSRVTISVDTSKNQFSLNLKSVTAADTAVYYCARGGQGGYDWGHYH
GLDVWGKGTTVTVSSASTKGPSVFPLAPSSKSTSGGTAALGCLVKDYFPEPVTVSWNSGALTSGVH
TFPAVLQSSGLYSLESVVTVPSSSLGTQTYICNVNHKPSNTKVDKKVEPKSC<u>GSGSGGSGSGGSSGG</u>
EVQLVESGGGLVQPGGSLRLSCAASGFTFSSYAMHWVRDAPGKGLEWVASISSTSGSKYYADSVK
GRFTISRDNSKNTLYLQMNSLRAEDTAVYSCAKTYYDFWSGYYTFDYWGDGTLVTVSSASTKGPSV
FPLAPSSKSTSGGTAALGCLVKDYFPEPVTVSWNSGALTSGVHTFPAVLQSSGLYSLKSVVTVPSSSL
GTQTYICNVNHKPSNTKVDKKVEPKSCDKTHTCPPCPAPEAAGGPSVFLFPPKPKDTLMISRTPEVTC
VVVDVSHEDPEVKFNWYVDGVEVHNAKTKPREEQYNSTYRVVSVLTVLHQDWLNGKEYKCKVSNKA
LGAPIEKTISKAKGQPREPQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSPGK* (SEQ ID NO:2225)

FIG. 19 (contd.)

*MDMRVPAQLLGLLLLWLRGARC*SYVLTQPPSVSVSPGQTASITCSGDKVGHKYASWYQDKPGQDP
VLVIYEDSQRPSGIPVRFSGSNSGNTATLTISGTQAMDEADYYCQAWDSSTDVVFGGGTKLTVLGQ
PKAAPSVTLFPPSSEELQANKATLVCLISDFYPGAVTVAWKADSSPVKAGVETTTPSKQSNNKYAAKS
YLSLTPEQWKSHRSYSCQVTHEGSTVEKTVAPTECS* (SEQ ID NO:2226)

*MDMRVPAQLLGLLLLWLRGARC*DIQMTQSPSSLSAYVGDRVTITCRVSQGISSYLNWYQKKPGKKP
KLLIYAASSLQSGVPSRFSGSGSGTDFTLTISSLQPEDFATYYCQQTYTIPFTFGPGTKVDIKRTVAAP
SVFIFPPSDEQLKSGTASVVCLLNNFYPREAKVQWKVDNALQSGNSQESVTEQDSKDSTYSLESTLTL
SKADYEKHKVYACEVTHQGLSSPVTKSFNRGEC* (SEQ ID NO:2227)

*MDMRVPAQLLGLLLLWLRGARC*QVQLQQWGAGLLKPSETLSLTCAVSGASFSGHYWTWIRKPPGK
GLEWIGEIDHTGSTNYEPSLRSRVTISVDTSKNQFSLNLKSVTAADTAVYYCARGGQGGYDWGHYH
GLDVWGKGTTVTVSSASTKGPSVFPLAPSSKSTSGGTAALGCLVKDYFPEPVTVSWNSGALTSGVH
TFPAVLQSSGLYSLESVVTVPSSSLGTQTYICNVNHKPSNTKVDKKVEPKSC<u>GSGSG</u>EVQLVESVGG
LVQPGGSLRLSCAASGFTFSSYAMHWVRDAPGKGLEWISTISGSGGSTYYADSVKGRFTISRDNSK
NTLYLQMNSLRAEDTAVYYCARAGYGRYYYGMDVWGDGTTVTVSSASTKGPSVFPLAPSSKSTSG
GTAALGCLVKDYFPEPVTVSWNSGALTSGVHTFPAVLQSSGLYSLKSVVTVPSSSLGTQTYICNVNHK
PSNTKVDKKVEPKSCDKTHTCPPCPAPEAAGGPSVFLFPPKPKDTLMISRTPEVTCVVVDVSHEDPE
VKFNWYVDGVEVHNAKTKPREEQYNSTYRVVSVLTVLHQDWLNGKEYKCKVSNKALGAPIEKTISKA
KGQPREPQVYTLPPSREEMTKNQVSLTCLVKGFYPSDIAVEWESNGQPENNYKTTPPVLDSDGSFFL
YSKLTVDKSRWQQGNVFSCSVMHEALHNHYTQKSLSLSPGK* (SEQ ID NO:2228)

*MDMRVPAQLLGLLLLWLRGARC*SYVLTQPPSVSVSPGQTASITCSGDKVGHKYASWYQDKPGQDP
VLVIYEDSQRPSGIPVRFSGSNSGNTATLTISGTQAMDEADYYCQAWDSSTDVVFGGGTKLTVLGQ
PKAAPSVTLFPPSSEELQANKATLVCLISDFYPGAVTVAWKADSSPVKAGVETTTPSKQSNNKYAAKS
YLSLTPEQWKSHRSYSCQVTHEGSTVEKTVAPTECS* (SEQ ID NO:2229)

*MDMRVPAQLLGLLLLWLRGARC*DIQMTQSPSSLSAYVGDRVTITCRVSQGISSYLNWYQKKPGKKP
KLLIYAASSLQSGVPSRFSGSGSGTDFTLTISSLQPEDFATYYCQQTYTIPFTFGPGTKVDIKRTVAAP
SVFIFPPSDEQLKSGTASVVCLLNNFYPREAKVQWKVDNALQSGNSQESVTEQDSKDSTYSLESTLTL
SKADYEKHKVYACEVTHQGLSSPVTKSFNRGEC* (SEQ ID NO:2230)

*MDMRVPAQLLGLLLLWLRGARC*QVQLQQWGAGLLKPSETLSLTCAVSGASFSGHYWTWIRKPPGK
GLEWIGEIDHTGSTNYEPSLRSRVTISVDTSKNQFSLNLKSVTAADTAVYYCARGGQGGYDWGHYH
GLDVWGKGTTVTVSSASTKGPSVFPLAPSSKSTSGGTAALGCLVKDYFPEPVTVSWNSGALTSGVH
TFPAVLQSSGLYSLESVVTVPSSSLGTQTYICNVNHKPSNTKVDKKVEPKSC<u>GSGSGGSGSG</u>EVQLV
ESVGGLVQPGGSLRLSCAASGFTFSSYAMHWVRDAPGKGLEWISTISGSGGSTYYADSVKGRFTIS
RDNSKNTLYLQMNSLRAEDTAVYYCARAGYGRYYYGMDVWGDGTTVTVSSASTKGPSVFPLAPSS
KSTSGGTAALGCLVKDYFPEPVTVSWNSGALTSGVHTFPAVLQSSGLYSLKSVVTVPSSSLGTQTYIC
NVNHKPSNTKVDKKVEPKSCDKTHTCPPCPAPEAAGGPSVFLFPPKPKDTLMISRTPEVTCVVVDVS
HEDPEVKFNWYVDGVEVHNAKTKPREEQYNSTYRVVSVLTVLHQDWLNGKEYKCKVSNKALGAPIE
KTISKAKGQPREPQVYTLPPSREEMTKNQVSLTCLVKGFYPSDIAVEWESNGQPENNYKTTPPVLDS
DGSFFLYSKLTVDKSRWQQGNVFSCSVMHEALHNHYTQKSLSLSPGK* (SEQ ID NO:2231)

*MDMRVPAQLLGLLLLWLRGARC*SYVLTQPPSVSVSPGQTASITCSGDKVGHKYASWYQDKPGQDP
VLVIYEDSQRPSGIPVRFSGSNSGNTATLTISGTQAMDEADYYCQAWDSSTDVVFGGGTKLTVLGQ
PKAAPSVTLFPPSSEELQANKATLVCLISDFYPGAVTVAWKADSSPVKAGVETTTPSKQSNNKYAAKS
YLSLTPEQWKSHRSYSCQVTHEGSTVEKTVAPTECS* (SEQ ID NO:2232)

*MDMRVPAQLLGLLLLWLRGARC*DIQMTQSPSSLSAYVGDRVTITCRVSQGISSYLNWYQKKPGKKP
KLLIYAASSLQSGVPSRFSGSGSGTDFTLTISSLQPEDFATYYCQQTYTIPFTFGPGTKVDIKRTVAAP
SVFIFPPSDEQLKSGTASVVCLLNNFYPREAKVQWKVDNALQSGNSQESVTEQDSKDSTYSLESTLTL
SKADYEKHKVYACEVTHQGLSSPVTKSFNRGEC* (SEQ ID NO:2233)

FIG. 19 (contd.)

*MDMRVPAQLLGLLLLWLRGARC*QVQLQQWGAGLLKPSETLSLTCAVSGASFSGHYWTWIRKPPGK
GLEWIGEIDHTGSTNYEPSLRSRVTISVDTSKNQFSLNLKSVTAADTAVYYCARGGQGGYDWGHYH
GLDVWGKGTTVTVSSASTKGPSVFPLAPSSKSTSGGTAALGCLVKDYFPEPVTVSWNSGALTSGVH
TFPAVLQSSGLYSLESVVTVPSSSLGTQTYICNVNHKPSNTKVDKKVEPKSC<u>GSGSGGSGSGGSSGG</u>
EVQLVESVGGLVQPGGSLRLSCAASGFTFSSYAMHWVRDAPGKGLEWISTISGSGGSTYYADSVK
GRFTISRDNSKNTLYLQMNSLRAEDTAVYYCARAGYGRYYYGMDVWGDGTTVTVSSASTKGPSVF
PLAPSSKSTSGGTAALGCLVKDYFPEPVTVSWNSGALTSGVHTFPAVLQSSGLYSLKSVVTVPSSSL
GTQTYICNVNHKPSNTKVDKKVEPKSCDKTHTCPPCPAPEAAGGPSVFLFPPKPKDTLMISRTPEVTC
VVVDVSHEDPEVKFNWYVDGVEVHNAKTKPREEQYNSTYRVVSVLTVLHQDWLNGKEYKCKVSNKA
LGAPIEKTISKAKGQPREPQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSPGK* (SEQ ID NO:2234)

*MDMRVPAQLLGLLLLWLRGARC*DIQMTQSPSSLSAYVGDRVTITCRVSQGISSYLNWYQKKPGKKP
KLLIYAASSLQSGVPSRFSGSGSGTDFTLTISSLQPEDFATYYCQQTYTIPFTFGPGTKVDIKRTVAAP
SVFIFPPSDEQLKSGTASVVCLLNNFYPREAKVQWKVDNALQSGNSQESVTEQDSKDSTYSLESTLTL
SKADYEKHKVYACEVTHQGLSSPVTKSFNRGEC* (SEQ ID NO:2235)

*MDMRVPAQLLGLLLLWLRGARC*SYVLTQPPSVSVSPGQTASITCSGDKVGHKYASWYQDKPGQDP
VLVIYEDSQRPSGIPVRFSGSNSGNTATLTISGTQAMDEADYYCQAWDSSTDVVFGGGTKLTVLGQ
PKAAPSVTLFPPSSEELQANKATLVCLISDFYPGAVTVAWKADSSPVKAGVETTTPSKQSNNKYAAKS
YLSLTPEQWKSHRSYSCQVTHEGSTVEKTVAPTECS* (SEQ ID NO:2236)

*MDMRVPAQLLGLLLLWLRGARC*EVQLVESVGGLVQPGGSLRLSCAASGFTFSSYAMHWVRDAPGK
GLEWISTISGSGGSTYYADSVKGRFTISRDNSKNTLYLQMNSLRAEDTAVYYCARAGYGRYYYGMD
VWGDGTTVTVSSASTKGPSVFPLAPSSKSTSGGTAALGCLVKDYFPEPVTVSWNSGALTSGVHTFPA
VLQSSGLYSLKSVVTVPSSSLGTQTYICNVNHKPSNTKVDKKVEPKSC<u>GSGSG</u>QVQLQQWGAGLLK
PSETLSLTCAVSGASFSGHYWTWIRKPPGKGLEWIGEIDHTGSTNYEPSLRSRVTISVDTSKNQFSL
NLKSVTAADTAVYYCARGGQGGYDWGHYHGLDVWGKGTTVTVSSASTKGPSVFPLAPSSKSTSGG
TAALGCLVKDYFPEPVTVSWNSGALTSGVHTFPAVLQSSGLYSLESVVTVPSSSLGTQTYICNVNHKP
SNTKVDKKVEPKSCDKTHTCPPCPAPEAAGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALGAPIEKTISKAK
GQPREPQVYTLPPSREEMTKNQVSLTCLVKGFYPSDIAVEWESNGQPENNYKTTPPVLDSDGSFFLY
SKLTVDKSRWQQGNVFSCSVMHEALHNHYTQKSLSLSPGK* (SEQ ID NO:2237)

*MDMRVPAQLLGLLLLWLRGARC*DIQMTQSPSSLSAYVGDRVTITCRVSQGISSYLNWYQKKPGKKP
KLLIYAASSLQSGVPSRFSGSGSGTDFTLTISSLQPEDFATYYCQQTYTIPFTFGPGTKVDIKRTVAAP
SVFIFPPSDEQLKSGTASVVCLLNNFYPREAKVQWKVDNALQSGNSQESVTEQDSKDSTYSLESTLTL
SKADYEKHKVYACEVTHQGLSSPVTKSFNRGEC* (SEQ ID NO:2238)

*MDMRVPAQLLGLLLLWLRGARC*SYVLTQPPSVSVSPGQTASITCSGDKVGHKYASWYQDKPGQDP
VLVIYEDSQRPSGIPVRFSGSNSGNTATLTISGTQAMDEADYYCQAWDSSTDVVFGGGTKLTVLGQ
PKAAPSVTLFPPSSEELQANKATLVCLISDFYPGAVTVAWKADSSPVKAGVETTTPSKQSNNKYAAKS
YLSLTPEQWKSHRSYSCQVTHEGSTVEKTVAPTECS* (SEQ ID NO:2239)

*MDMRVPAQLLGLLLLWLRGARC*EVQLVESVGGLVQPGGSLRLSCAASGFTFSSYAMHWVRDAPGK
GLEWISTISGSGGSTYYADSVKGRFTISRDNSKNTLYLQMNSLRAEDTAVYYCARAGYGRYYYGMD
VWGDGTTVTVSSASTKGPSVFPLAPSSKSTSGGTAALGCLVKDYFPEPVTVSWNSGALTSGVHTFPA
VLQSSGLYSLKSVVTVPSSSLGTQTYICNVNHKPSNTKVDKKVEPKSC<u>GSGSGGSGSG</u>QVQLQQWG
AGLLKPSETLSLTCAVSGASFSGHYWTWIRKPPGKGLEWIGEIDHTGSTNYEPSLRSRVTISVDTSK
NQFSLNLKSVTAADTAVYYCARGGQGGYDWGHYHGLDVWGKGTTVTVSSASTKGPSVFPLAPSSK
STSGGTAALGCLVKDYFPEPVTVSWNSGALTSGVHTFPAVLQSSGLYSLESVVTVPSSSLGTQTYICN
VNHKPSNTKVDKKVEPKSCDKTHTCPPCPAPEAAGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALGAPIEK
TISKAKGQPREPQVYTLPPSREEMTKNQVSLTCLVKGFYPSDIAVEWESNGQPENNYKTTPPVLDSD
GSFFLYSKLTVDKSRWQQGNVFSCSVMHEALHNHYTQKSLSLSPGK* (SEQ ID NO:2240)

FIG. 19 (contd.)

*MDMRVPAQLLGLLLLWLRGARC***DIQMTQSPSSLSAYVGDRVTITCRVSQGISSYLNWYQKKPGKKP
KLLIYAASSLQSGVPSRFSGSGSGTDFTLTISSLQPEDFATYYCQQTYTIPFTGPGTKVDIKRTVAAP
SVFIFPPSDEQLKSGTASVVCLLNNFYPREAKVQWKVDNALQSGNSQESVTEQDSKDSTYSLESTLTL
SKADYEKHKVYACEVTHQGLSSPVTKSFNRGEC*** (SEQ ID NO:2241)

*MDMRVPAQLLGLLLLWLRGARC***SYVLTQPPSVSVSPGQTASITCSGDKVGHKYASWYQDKPGQDP
VLVIYEDSQRPSGIPVRFSGSNSGNTATLTISGTQAMDEADYYCQAWDSSTDVVFGGGTKLTVLGQ
PKAAPSVTLFPPSSEELQANKATLVCLISDFYPGAVTVAWKADSSPVKAGVETTTPSKQSNNKYAAKS
YLSLTPEQWKSHRSYSCQVTHEGSTVEKTVAPTECS*** (SEQ ID NO:2242)

*MDMRVPAQLLGLLLLWLRGARC***EVQLVESVGGLVQPGGSLRLSCAASGFTFSSYAMHWVRDAPGK
GLEWISTISGSGGSTYYADSVKGRFTISRDNSKNTLYLQMNSLRAEDTAVYYCARAGYGRYYYGMD
VWGDGTTVTVSS**ASTKGPSVFPLAPSSKSTSGGTAALGCLVKDYFPEPVTVSWNSGALTSGVHTFPA
VLQSSGLYSLKSVVTVPSSSLGTQTYICNVNHKPSNTKVDKKVEPKSC<u>GSGSGGSGSGGSSGG</u>**QVQ
LQQWGAGLLKPSETLSLTCAVSGASFSGHYWTWIRKPPGKGLEWIGEIDHTGSTNYEPSLRSRVTIS
VDTSKNQFSLNLKSVTAADTAVYYCARGGQGGYDWGHYHGLDVWGKGTTVTVSS**ASTKGPSVFPL
APSSKSTSGGTAALGCLVKDYFPEPVTVSWNSGALTSGVHTFPAVLQSSGLYSLESVVTVPSSSLGT
QTYICNVNHKPSNTKVDKKVEPKSCDKTHTCPPCPAPEAAGGPSVFLFPPKPKDTLMISRTPEVTCVV
VDVSHEDPEVKFNWYVDGVEVHNAKTKPREEQYNSTYRVVSVLTVLHQDWLNGKEYKCKVSNKALG
APIEKTISKAKGQPREPQVYTLPPSREEMTKNQVSLTCLVKGFYPSDIAVEWESNGQPENNYKTTPPV
LDSDGSFFLYSKLTVDKSRWQQGNVFSCSVMHEALHNHYTQKSLSLSPGK* (SEQ ID NO:2243)

*MDMRVPAQLLGLLLLWLRGARC***QVQLQQWGAGLLKPSETLSLTCAVSGASFSGHYWTWIRQPPGK
GLEWIGEIDHTGSTNYEPSLRSRVTISVDTSKNQFSLNLKSVTAADTAVYYCARGGQGGYDWGHYH
GLDVWGQGTTVTVSS**ASTKGPSVFPLAPSSKSTSGGTAALGCLVKDYFPEPVTVSWNSGALTSGVH
TFPAVLQSSGLYSLSSVVTVPSSSLGTQTYICNVNHKPSNTKVDKKVEPKSC<u>GSGSG</u>HHHHHH*
(SEQ ID NO:2244)

*MDMRVPAQLLGLLLLWLRGARC***DIQMTQSPSSLSASVGDRVTITCRASQSISSYLNWYQQKPGKAP
KLLIYAASSLQSGVPSRFSGSGSGTDFTLTISSLQPEDFATYYCQQSYSTPLTFGGGTKVEIKRTVAA
PSVFIFPPSDEQLKSGTASVVCLLNNFYPREAKVQWKVDNALQSGNSQESVTEQDSKDSTYSLSSTL
TLSKADYEKHKVYACEVTHQGLSSPVTKSFNRGEC*** (SEQ ID NO:2245)

*MDMRVPAQLLGLLLLWLRGARC***SYVLTQPPSVSVSPGQTASITCSGDKVGHKYASWYQQKPGQSP
VLVIYEDSQRPSGIPVRFSGSNSGNTATLTISGTQAMDEADYYCQAWDSSTDVVFGGGTKLTVLGQ
PKAAPSVTLFPPSSEELQANKATLVCLISDFYPGAVTVAWKADSSPVKAGVETTTPSKQSNNKYAASS
YLSLTPEQWKSHRSYSCQVTHEGSTVEKTVAPTECS<u>GSGSG</u>EVQLVESGGGLVQPGGSLRLSCAA
SGFTFSSYAMHWVRQAPGKGLEWVASISSTSGSKYYADSVKGRFTISRDNSKNTLYLQMNSLRAE
DTAVYSCAKTYYDFWSGYYTFDYWGQGTLVTVSS**ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEP
KSCDKTHTCPPCPAPEAAGGPSVFLFPPKPKDTLMISRTPEVTCVVVDVSHEDPEVKFNWYVDGVEV
HNAKTKPREEQYNSTYRVVSVLTVLHQDWLNGKEYKCKVSNKALGAPIEKTISKAKGQPREPQVYTL
PPSREEMTKNQVSLTCLVKGFYPSDIAVEWESNGQPENNYKTTPPVLDSDGSFFLYSKLTVDKSRWQ
QGNVFSCSVMHEALHNHYTQKSLSLSPGK* (SEQ ID NO:2246)

*MDMRVPAQLLGLLLLWLRGARC***DVKLVESGGGLVKLGGSLRLSCAASGFSFSTSYMSWVRQTPEK
RLELVAAINLNGGSTYYSDTVKGRFTISRDNAKNTLYLQMSSLKSEDTAFYYCASELAGYGTPFAYW
GQGTLVTVSA**ASTKGPSVFPLAPSSKSTSGGTAALGCLVKDYFPEPVTVSWNSGALTSGVHTFPAVL
QSSGLYSLSSVVTVPSSSLGTQTYICNVNHKPSNTKVDKKVEPKSC<u>GSGSG</u>HHHHHH* (SEQ ID
NO:2247)

FIG. 19 (contd.)

*MDMRVPAQLLGLLLLWLRGARC*AAADIVLTQSPATLSVTPGDSVSLSCKASQSISYNLHWYQQKSHE
SPRLLIKYTSQSISGIPSRFSGSGSGTDFTLTINNVETEDFGMYFCQQSNSWPLTFGAGTKLEVKRTV
AAPSVFIFPPSDEQLKSGTASVVCLLNNFYPREAKVQWKVDNALQSGNSQESVTEQDSKDSTYSLSS
TLTLSKADYEKHKVYACEVTHQGLSSPVTKSFNRGECGGGGSEVQLVQSGAEVKKPGASVKVSCK
ASGYTFTSYGISWVRQAPGQGLEWMGWISAYNGNTNYAQKLQGRVTMTTDTSTSTAYMELRSLRS
DDTAVYYCASSKEKATYYYGMDVWGQGTTVTVSSASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEP
KSCDKTHTCPPCPAPEAAGGPSVFLFPPKPKDTLMISRTPEVTCVVVDVSHEDPEVKFNWYVDGVEV
HNAKTKPREEQYNSTYRVVSVLTVLHQDWLNGKEYKCKVSNKALGAPIEKTISKAKGQPREPQVYTL
PPSREEMTKNQVSLTCLVKGFYPSDIAVEWESNGQPENNYKTTPPVLDSDGSFFLYSKLTVDKSRWQ
QGNVFSCSVMHEALHNHYTQKSLSLSPGKGSGSG HHHHHH* (SEQ ID NO:2248)

*MDMRVPAQLLGLLLLWLRGARC*AAADIVLTQSPATLSVTPGDSVSLSCKASQSISYNLHWYQQKSHE
SPRLLIKYTSQSISGIPSRFSGSGSGTDFTLTINNVETEDFGMYFCQQSNSWPLTFGAGTKLEVKRTV
AAPSVFIFPPSDEQLKSGTASVVCLLNNFYPREAKVQWKVDNALQSGNSQESVTEQDSKDSTYSLSS
TLTLSKADYEKHKVYACEVTHQGLSSPVTKSFNRGECGGGGSGGGGSEVQLVQSGAEVKKPGASV
KVSCKASGYTFTSYGISWVRQAPGQGLEWMGWISAYNGNTNYAQKLQGRVTMTTDTSTSTAYMEL
RSLRSDDTAVYYCASSKEKATYYYGMDVWGQGTTVTVSSASTKGPSVFPLAPSSKSTSGGTAALGC
LVKDYFPEPVTVSWNSGALTSGVHTFPAVLQSSGLYSLSSVVTVPSSSLGTQTYICNVNHKPSNTKVD
KKVEPKSCDKTHTCPPCPAPEAAGGPSVFLFPPKPKDTLMISRTPEVTCVVVDVSHEDPEVKFNWYV
DGVEVHNAKTKPREEQYNSTYRVVSVLTVLHQDWLNGKEYKCKVSNKALGAPIEKTISKAKGQPREP
QVYTLPPSREEMTKNQVSLTCLVKGFYPSDIAVEWESNGQPENNYKTTPPVLDSDGSFFLYSKLTVD
KSRWQQGNVFSCSVMHEALHNHYTQKSLSLSPGKGSGSGHHHHHH* (SEQ ID NO:2249)

*MDMRVPAQLLGLLLLWLRGARC*EVQLVESGGGLVQPGGSLRLSCAASGFTFSHYTLSWVRQAPGK
GLEWVSVISGDGSYTYYADSVKGRFTISSDNSKNTLYLQMNSLRAEDTAVYYCARNFIKYVFANWG
QGTLVTVSSGGGGSGGGGSGGGGSDIELTQPPSVSVAPGQTARISCSGDNIGSFYVHWYQQKPGQ
APVLVIYDKSNRPSGIPERFSGSNSGNTATLTISGTQAEDEADYYCQSYANTLSLVFGGGTKLTVLG
SGSGDKTHTCPPCPAPEAAGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALGAPIEKTISKAKGQPREPQVYT
LPPSREEMTKNQVSLTCLVKGFYPSDIAVEWESNGQPENNYKTTPPVLDSDGSFFLYSKLTVDKSRW
QQGNVFSCSVMHEALHNHYTQKSLSLSPGKGSGSGEVQLVESGGGLVQPGGSLRLSCAASGFTFT
SYYISWVRQAPGKGLEWVAEISPYSGSTYYADSVKGRFTISADTSKNTAYLQMNSLRAEDTAVYYC
ALRARPPIRLHPRGSVMDYWGQGTLVTVSSGSAASGSSGGSSSGADIQMTQSPSSLSASVGDRVTI
TCRASQDVSTAVAWYQQKPGKAPKLLIYSASFLYSGVPSRFSGSGSGTDFTLTISSLQPEDFATYYC
QQSYTTPPTFGQGTKVEIK* (SEQ ID 2250)

*MDMRVPAQLLGLLLLWLRGARC*EVQLVQSGAEVKKPGASVKVSCKASGYTFTSYGISWVRQAPGQ
GLEWMGWISAYNGNTNYAQKLQGRVTMTTDTSTSTAYMELRSLRSDDTAVYYCASSKEKATYYYG
MDVWGQGTTVTVSSASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPEAAG*
(SEQ ID 2251)

*MDMRVPAQLLGLLLLWLRGARC*DIQMTQSPSSLSASVGDRVTITCRASQSISSYLNWYQQKPGKAPK
LLIYAASSLQSGVPSRFSGSGSGTDFTLTISSLQPEDFATYYCQQSYSTPLTFGGGTKVEIKGSGSGSY
VLTQPPSVSVSPGQTASITCSGDKVGHKYASWYQQKPGQSPVLVIYEDSQRPSGIPVRFSGSNSGNT
ATLTISGTQAMDEADYYCQAWDSSTDVVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTV
EKTVAPTECS* (SEQ ID 2252)

FIG. 19 (contd.)

*MDMRVPAQLLGLLLLWLRGARC*QVQLVQSGAEVKKPGSSVKVSCKASGYTFTYRYLHWVRQAPGQ
GLEWMGRIIPVLKITNYAQKFQGRVTITADESTSTAYMELSSLRSEDTAVYYCAVVDDAFDIWGQGTM
VTVSSGSGSGQVQLQQWGAGLLKPSETLSLTCAVSGASFSGHYWTWIRQPPGKGLEWIGEIDHTGS
TNYEPSLRSRVTISVDTSKNQFSLNLKSVTAADTAVYYCARGGQGGYDWGHYHGLDVWGQGTTVTV
SSASTKGPSVFPLAPSSKSTSGGTAALGCLVKDYFPEPVTVSWNSGALTSGVHTFPAVLQSSGLYSL
SSVVTVPSSSLGTQTYICNVNHKPSNTKVDKKVEPKSCDKTHTCPPCPAPEAAGGPSVFLFPPKPKDT
LMISRTPEVTCVVVDVSHEDPEVKFNWYVDGVEVHNAKTKPREEQYNSTYRVVSVLTVLHQDWLNG
KEYKCKVSNKALGAPIEKTISKAKGQPREPQVYTLPPSREEMTKNQVSLTCLVKGFYPSDIAVEWESN
GQPENNYKTTPPVLDSDGSFFLYSKLTVDKSRWQQGNVFSCSVMHEALHNHYTQKSLSLSPGK*
(SEQID 2253)

*MDMRVPAQLLGLLLLWLRGARC*EVQLVQSGAEVKKPGASVKVSCKASGYTFTSYGISWVRQAPGQ
GLEWMGWISAYNGNTNYAQKLQGRVTMTTDTSTSTAYMELRSLRSDDTAVYYCASSKEKATYYYG
MDVWGQGTTVTVSSASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPEAAG
GPSVFLFPPKPKDTLMISRTPEVTCVVVDVSHEDPEVKFNWYVDGVEVHNAKTKPREEQYNSTYRVV
SVLTVLHQDWLNGKEYKCKVSNKALGAPIEKTISKAKGQPREPQVYTLPPSREEMTKNQVSLTCLVKG
FYPSDIAVEWESNGQPENNYKTTPPVLDSDGSFFLYSKLTVDKSRWQQGNVFSCSVMHEALHNHYT
QKSLSLSPGK* (SEQ ID NO:2254)

*MDMRVPAQLLGLLLLWLRGARC*EVQLVESGGGLVQPGGSLRLSCAASGFTFSHYTLSWVRQAPGK
GLEWVSVISGDGSYTYYADSVKGRFTISSDNSKNTLYLQMNSLRAEDTAVYYCARNFIKYVFANWG
QGTLVTVSSGGGGSGGGGSGGGGSDIELTQPPSVSVAPGQTARISCSGDNIGSFYVHWYQQKPGQ
APVLVIYDKSNRPSGIPERFSGSNSGNTATLTISGTQAEDEADYYCQSYANTLSLVFGGGTKLTVL<u>G
SGSG</u>DVKLVESGGGLVKLGGSLRLSCAASGFSFSTSYMSWVRQTPEKRLELVAAINLNGGSTYYS
DTVKGRFTISRDNAKNTLYLQMSSLKSEDTAFYYCASELAGYGTPFAYWGQGTLVTVSA<u>GSAASGS
SGGSSSGA</u>DIVLTQSPATLSVTPGDSVSLSCKASQSISYNLHWYQQKSHESPRLLIKYTSQSISGIPS
RFSGSGSGTDFTLTINNVETEDFGMYFCQQSNSWPLTFGAGTKLEVK<u>GSGSG</u>HHHHHH* (SEQ ID
NO:225)
5
*MDMRVPAQLLGLLLLWLRGARC*EVQLVESGGGLVQPGGSLRLSCAASGFTFSHYTLSWVRQAPGK
GLEWVSVISGDGSYTYYADSVKGRFTISSDNSKNTLYLQMNSLRAEDTAVYYCARNFIKYVFANWG
QGTLVTVSSGGGGSGGGGSGGGGSDIELTQPPSVSVAPGQTARISCSGDNIGSFYVHWYQQKPGQ
APVLVIYDKSNRPSGIPERFSGSNSGNTATLTISGTQAEDEADYYCQSYANTLSLVFGGGTKLTVL<u>G
SGSGGSGSG</u>DVKLVESGGGLVKLGGSLRLSCAASGFSFSTSYMSWVRQTPEKRLELVAAINLNGG
STYYSDTVKGRFTISRDNAKNTLYLQMSSLKSEDTAFYYCASELAGYGTPFAYWGQGTLVTVSA<u>GS
AASGSSGGSSSGA</u>DIVLTQSPATLSVTPGDSVSLSCKASQSISYNLHWYQQKSHESPRLLIKYTSQSI
SGIPSRFSGSGSGTDFTLTINNVETEDFGMYFCQQSNSWPLTFGAGTKLEVK<u>GSGSG</u>HHHHHH*
(SEQ ID NO:2256)

*MDMRVPAQLLGLLLLWLRGARC*EVQLVESGGGLVQPGGSLRLSCAASGFTFSHYTLSWVRQAPGK
GLEWVSVISGDGSYTYYADSVKGRFTISSDNSKNTLYLQMNSLRAEDTAVYYCARNFIKYVFANWG
QGTLVTVSSGGGGSGGGGSGGGGSDIELTQPPSVSVAPGQTARISCSGDNIGSFYVHWYQQKPGQ
APVLVIYDKSNRPSGIPERFSGSNSGNTATLTISGTQAEDEADYYCQSYANTLSLVFGGGTKLTVL<u>G
SGSGGSGSGGSSGG</u>DVKLVESGGGLVKLGGSLRLSCAASGFSFSTSYMSWVRQTPEKRLELVAAI
NLNGGSTYYSDTVKGRFTISRDNAKNTLYLQMSSLKSEDTAFYYCASELAGYGTPFAYWGQGTLVT
VSA<u>GSAASGSSGGSSSGA</u>DIVLTQSPATLSVTPGDSVSLSCKASQSISYNLHWYQQKSHESPRLLIK
YTSQSISGIPSRFSGSGSGTDFTLTINNVETEDFGMYFCQQSNSWPLTFGAGTKLEVK<u>GSGSG</u>HHHH
HH* (SEQ ID NO:2257)

FIG. 19 (contd.)

*MDMRVPAQLLGLLLLWLRGARC*DVKLVESGGGLVKLGGSLRLSCAASGFSFSTSYMSWVRQTPEK
RLELVAAINLNGGSTYYSDTVKGRFTISRDNAKNTLYLQMSSLKSEDTAFYYCASELAGYGTPFAYW
GQGTLVTVSA<u>GSAASGSSGGSSSGA</u>DIVLTQSPATLSVTPGDSVSLSCKASQSISYNLHWYQQKSH
ESPRLLIKYTSQSISGIPSRFSGSGSGTDFTLTINNVETEDFGMYFCQQSNSWPLTFGAGTKLEVK<u>GS
GSG</u>EVQLVESGGGLVQPGGSLRLSCAASGFTFSHYTLSWVRQAPGKGLEWVSVISGDGSYTYYAD
SVKGRFTISSDNSKNTLYLQMNSLRAEDTAVYYCARNFIKYVFANWGQGTLVTVSS<u>GGGGSGGGG
SGGGGS</u>DIELTQPPSVSVAPGQTARISCSGDNIGSFYVHWYQQKPGQAPVLVIYDKSNRPSGIPERF
SGSNSGNTATLTISGTQAEDEADYYCQSYANTLSLVFGGGTKLTVL<u>GSGSG</u>HHHHHH* (SEQ ID
NO:2258)

*MDMRVPAQLLGLLLLWLRGARC*DVKLVESGGGLVKLGGSLRLSCAASGFSFSTSYMSWVRQTPEK
RLELVAAINLNGGSTYYSDTVKGRFTISRDNAKNTLYLQMSSLKSEDTAFYYCASELAGYGTPFAYW
GQGTLVTVSA<u>GSAASGSSGGSSSGA</u>DIVLTQSPATLSVTPGDSVSLSCKASQSISYNLHWYQQKSH
ESPRLLIKYTSQSISGIPSRFSGSGSGTDFTLTINNVETEDFGMYFCQQSNSWPLTFGAGTKLEVK<u>GS
GSGGSGSG</u>EVQLVESGGGLVQPGGSLRLSCAASGFTFSHYTLSWVRQAPGKGLEWVSVISGDGS
YTYYADSVKGRFTISSDNSKNTLYLQMNSLRAEDTAVYYCARNFIKYVFANWGQGTLVTVSS<u>GGGG
SGGGGSGGGGS</u>DIELTQPPSVSVAPGQTARISCSGDNIGSFYVHWYQQKPGQAPVLVIYDKSNRPS
GIPERFSGSNSGNTATLTISGTQAEDEADYYCQSYANTLSLVFGGGTKLTVL<u>GSGSG</u>HHHHHH*
(SEQ ID NO:2259)

*MDMRVPAQLLGLLLLWLRGARC*DVKLVESGGGLVKLGGSLRLSCAASGFSFSTSYMSWVRQTPEK
RLELVAAINLNGGSTYYSDTVKGRFTISRDNAKNTLYLQMSSLKSEDTAFYYCASELAGYGTPFAYW
GQGTLVTVSA<u>GSAASGSSGGSSSGA</u>DIVLTQSPATLSVTPGDSVSLSCKASQSISYNLHWYQQKSH
ESPRLLIKYTSQSISGIPSRFSGSGSGTDFTLTINNVETEDFGMYFCQQSNSWPLTFGAGTKLEVK<u>GS
GSGGSGSGGSSGG</u>EVQLVESGGGLVQPGGSLRLSCAASGFTFSHYTLSWVRQAPGKGLEWVSVI
SGDGSYTYYADSVKGRFTISSDNSKNTLYLQMNSLRAEDTAVYYCARNFIKYVFANWGQGTLVTVS
S<u>GGGGSGGGGSGGGGS</u>DIELTQPPSVSVAPGQTARISCSGDNIGSFYVHWYQQKPGQAPVLVIYD
KSNRPSGIPERFSGSNSGNTATLTISGTQAEDEADYYCQSYANTLSLVFGGGTKLTVL<u>GSGSG</u>HHH
HHH* (SEQ ID NO:2260)

*MDMRVPAQLLGLLLLWLRGARC*EVQLVESGGGLVQPGGSLRLSCAASGFTFSHYTLSWVRQAPGK
GLEWVSVISGDGSYTYYADSVKGRFTISSDNSKNTLYLQMNSLRAEDTAVYYCARNFIKYVFANWG
QGTLVTVSS<u>GGGGSGGGGSGGGGS</u>DIELTQPPSVSVAPGQTARISCSGDNIGSFYVHWYQQKPGQ
APVLVIYDKSNRPSGIPERFSGSNSGNTATLTISGTQAEDEADYYCQSYANTLSLVFGGGTKLTVL<u>G
SGSG</u>EVQLVESGGGLVQPGGSLRLSCAASGFTFTSYYISWVRQAPGKGLEWVAEISPYSGSTYYAD
SVKGRFTISADTSKNTAYLQMNSLRAEDTAVYYCALRARPPIRLHPRGSVMDYWGQGTLVTVSS<u>GS
AASGSSGGSSSGA</u>DIQMTQSPSSLSASVGDRVTITCRASQDVSTAVAWYQQKPGKAPKLLIYSASF
LYSGVPSRFSGSGSGTDFTLTISSLQPEDFATYYCQQSYTTPPTFGQGTKVEIK<u>GSGSG</u>HHHHHH*
(SEQ ID NO:2261)

*MDMRVPAQLLGLLLLWLRGARC*EVQLVESGGGLVQPGGSLRLSCAASGFTFSHYTLSWVRQAPGK
GLEWVSVISGDGSYTYYADSVKGRFTISSDNSKNTLYLQMNSLRAEDTAVYYCARNFIKYVFANWG
QGTLVTVSS<u>GGGGSGGGGSGGGGS</u>DIELTQPPSVSVAPGQTARISCSGDNIGSFYVHWYQQKPGQ
APVLVIYDKSNRPSGIPERFSGSNSGNTATLTISGTQAEDEADYYCQSYANTLSLVFGGGTKLTVL<u>G
SGSGGSGSG</u>EVQLVESGGGLVQPGGSLRLSCAASGFTFTSYYISWVRQAPGKGLEWVAEISPYSG
STYYADSVKGRFTISADTSKNTAYLQMNSLRAEDTAVYYCALRARPPIRLHPRGSVMDYWGQGTLV
TVSS<u>GSAASGSSGGSSSGA</u>DIQMTQSPSSLSASVGDRVTITCRASQDVSTAVAWYQQKPGKAPKLL
IYSASFLYSGVPSRFSGSGSGTDFTLTISSLQPEDFATYYCQQSYTTPPTFGQGTKVEIK<u>GSGSG</u>HHH
HHH* (SEQ ID NO:2262)

FIG. 19 (contd.)

*MDMRVPAQLLGLLLLWLRGAR*CEVQLVESGGGLVQPGGSLRLSCAASGFTFSHYTLSWVRQAPGK
GLEWVSVISGDGSYTYYADSVKGRFTISSDNSKNTLYLQMNSLRAEDTAVYYCARNFIKYVFANWG
QGTLVTVSS<u>GGGGSGGGGSGGGGS</u>DIELTQPPSVSVAPGQTARISCSGDNIGSFYVHWYQQKPGQ
APVLVIYDKSNRPSGIPERFSGSNSGNTATLTISGTQAEDEADYYCQSYANTLSLVFGGGTKLTVL<u>G
SGSGGGSGSGGSSGG</u>EVQLVESGGGLVQPGGSLRLSCAASGFTFTSYYISWVRQAPGKGLEWVAEI
SPYSGSTYYADSVKGRFTISADTSKNTAYLQMNSLRAEDTAVYYCALRARPPIRLHPRGSVMDYWG
QGTLVTVSS<u>GSAASGSSGGSSSGA</u>DIQMTQSPSSLSASVGDRVTITCRASQDVSTAVAWYQQKPG
KAPKLLIYSASFLYSGVPSRFSGSGSGTDFTLTISSLQPEDFATYYCQQSYTTPPTFGQGTKVEIK<u>GS
GSG</u>HHHHHH* (SEQ ID NO:2263)

*MDMRVPAQLLGLLLLWLRGAR*CEVQLVESGGGLVQPGGSLRLSCAASGFTFTSYYISWVRQAPGK
GLEWVAEISPYSGSTYYADSVKGRFTISADTSKNTAYLQMNSLRAEDTAVYYCALRARPPIRLHPRG
SVMDYWGQGTLVTVSS<u>GSAASGSSGGSSSGA</u>DIQMTQSPSSLSASVGDRVTITCRASQDVSTAVA
WYQQKPGKAPKLLIYSASFLYSGVPSRFSGSGSGTDFTLTISSLQPEDFATYYCQQSYTTPPTFGQG
TKVEIK<u>GSGSG</u>EVQLVESGGGLVQPGGSLRLSCAASGFTFSHYTLSWVRQAPGKGLEWVSVISGD
GSYTYYADSVKGRFTISSDNSKNTLYLQMNSLRAEDTAVYYCARNFIKYVFANWGQGTLVTVSS<u>GG
GGSGGGGSGGGGS</u>DIELTQPPSVSVAPGQTARISCSGDNIGSFYVHWYQQKPGQAPVLVIYDKSNR
PSGIPERFSGSNSGNTATLTISGTQAEDEADYYCQSYANTLSLVFGGGTKLTVL<u>GSGSG</u>HHHHHH*
(SEQ ID NO:2264)

*MDMRVPAQLLGLLLLWLRGAR*CEVQLVESGGGLVQPGGSLRLSCAASGFTFTSYYISWVRQAPGK
GLEWVAEISPYSGSTYYADSVKGRFTISADTSKNTAYLQMNSLRAEDTAVYYCALRARPPIRLHPRG
SVMDYWGQGTLVTVSS<u>GSAASGSSGGSSSGA</u>DIQMTQSPSSLSASVGDRVTITCRASQDVSTAVA
WYQQKPGKAPKLLIYSASFLYSGVPSRFSGSGSGTDFTLTISSLQPEDFATYYCQQSYTTPPTFGQG
TKVEIK<u>GSGSGGSGS</u>GEVQLVESGGGLVQPGGSLRLSCAASGFTFSHYTLSWVRQAPGKGLEWVS
VISGDGSYTYYADSVKGRFTISSDNSKNTLYLQMNSLRAEDTAVYYCARNFIKYVFANWGQGTLVTV
SS<u>GGGGSGGGGSGGGGS</u>DIELTQPPSVSVAPGQTARISCSGDNIGSFYVHWYQQKPGQAPVLVIY
DKSNRPSGIPERFSGSNSGNTATLTISGTQAEDEADYYCQSYANTLSLVFGGGTKLTVL<u>GSGSG</u>HH
HHHH* (SEQ ID NO:2265)

*MDMRVPAQLLGLLLLWLRGAR*CEVQLVESGGGLVQPGGSLRLSCAASGFTFTSYYISWVRQAPGK
GLEWVAEISPYSGSTYYADSVKGRFTISADTSKNTAYLQMNSLRAEDTAVYYCALRARPPIRLHPRG
SVMDYWGQGTLVTVSS<u>GSAASGSSGGSSSGA</u>DIQMTQSPSSLSASVGDRVTITCRASQDVSTAVA
WYQQKPGKAPKLLIYSASFLYSGVPSRFSGSGSGTDFTLTISSLQPEDFATYYCQQSYTTPPTFGQG
TKVEIK<u>GSGSGGSGSGGSSGG</u>EVQLVESGGGLVQPGGSLRLSCAASGFTFSHYTLSWVRQAPGK
GLEWVSVISGDGSYTYYADSVKGRFTISSDNSKNTLYLQMNSLRAEDTAVYYCARNFIKYVFANWG
QGTLVTVSS<u>GGGGSGGGGSGGGGS</u>DIELTQPPSVSVAPGQTARISCSGDNIGSFYVHWYQQKPGQ
APVLVIYDKSNRPSGIPERFSGSNSGNTATLTISGTQAEDEADYYCQSYANTLSLVFGGGTKLTVL<u>G
SGSG</u>HHHHHH* (SEQ ID NO:2266)

*MDMRVPAQLLGLLLLWLRGAR*CEVQLVESGGGLVQPGGSLRLSCAASGFTFTSYYISWVRQAPGK
GLEWVAEISPYSGSTYYADSVKGRFTISADTSKNTAYLQMNSLRAEDTAVYYCALRARPPIRLHPRG
SVMDYWGQGTLVTVSS<u>GSAASGSSGGSSSGA</u>DIQMTQSPSSLSASVGDRVTITCRASQDVSTAVA
WYQQKPGKAPKLLIYSASFLYSGVPSRFSGSGSGTDFTLTISSLQPEDFATYYCQQSYTTPPTFGQG
TKVEIK<u>GSGSG</u>DKTHTCPPCPAPEAAGGPSVFLFPPKPKDTLMISRTPEVTCVVVDVSHEDPEVKFN
WYVDGVEVHNAKTKPREEQYNSTYRVVSVLTVLHQDWLNGKEYKCKVSNKALGAPIEKTISKAKGQP
REPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK<u>GSGSG</u>EVQLVESGGGLVQPGGSLRLSCA
ASGFTFSHYTLSWVRQAPGKGLEWVSVISGDGSYTYYADSVKGRFTISSDNSKNTLYLQMNSLRAE
DTAVYYCARNFIKYVFANWGQGTLVTVSS<u>GGGGSGGGGSGGGGS</u>DIELTQPPSVSVAPGQTARIS
CSGDNIGSFYVHWYQQKPGQAPVLVIYDKSNRPSGIPERFSGSNSGNTATLTISGTQAEDEADYYCQ
SYANTLSLVFGGGTKLTVL* (SEQ ID NO:2267)

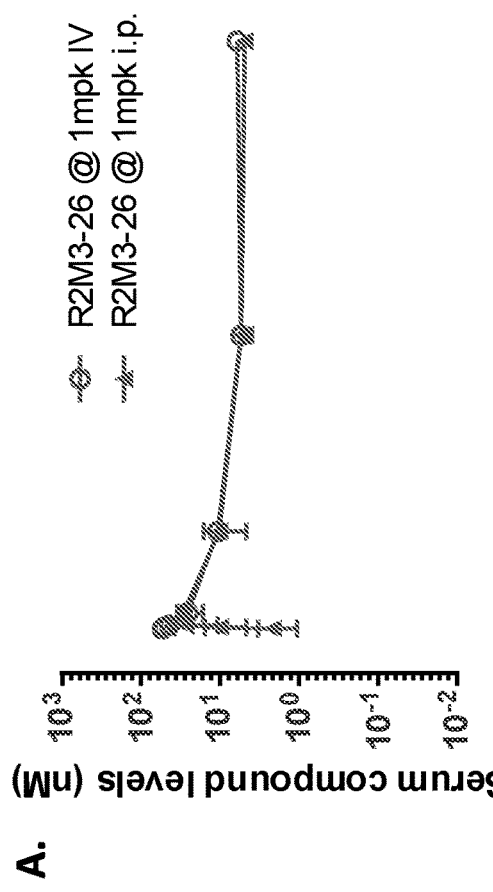
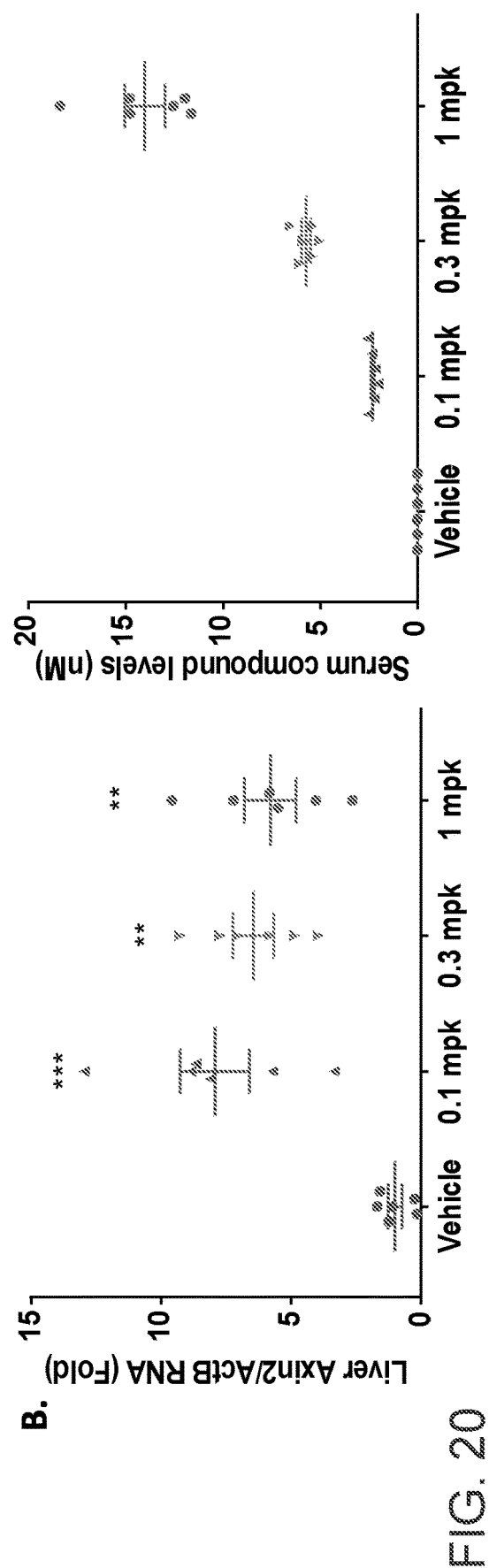
FIG. 20

A.
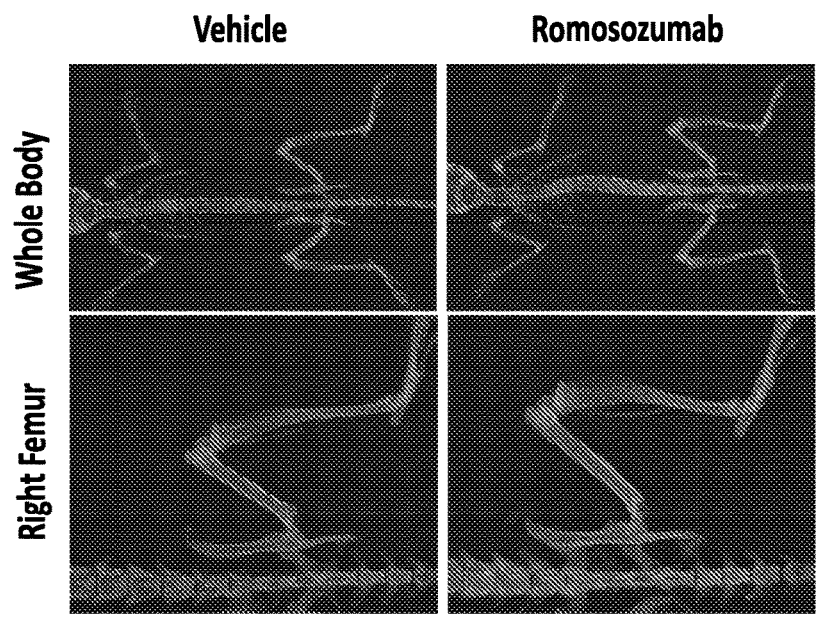
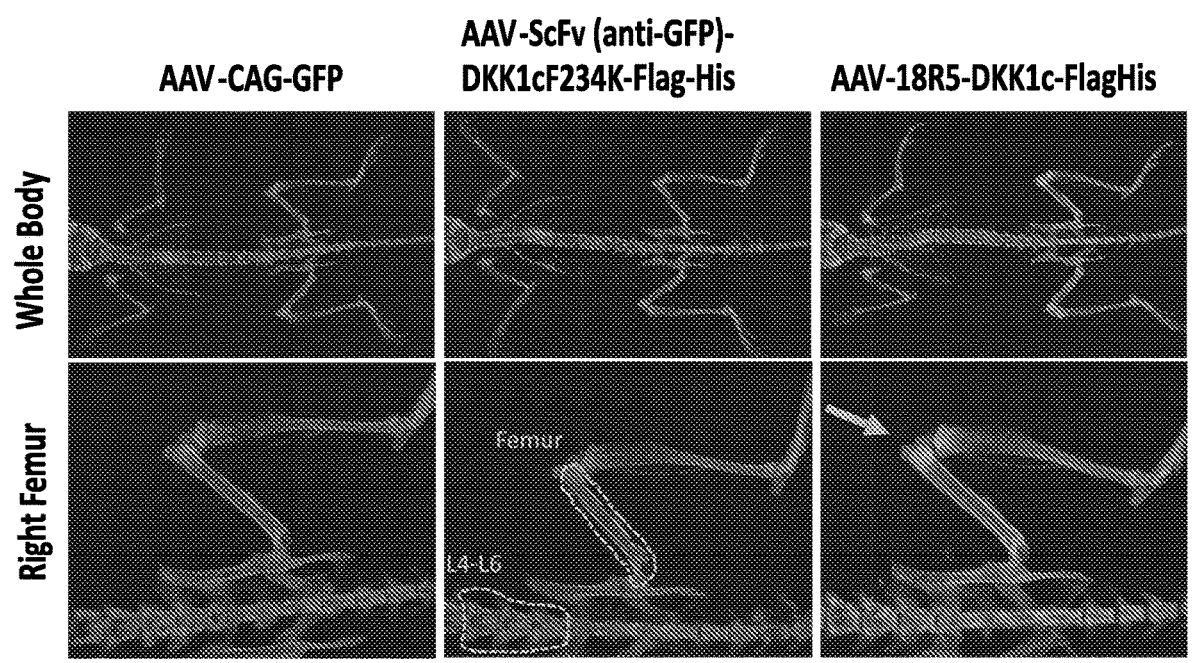
FIG. 21A

Vehicle
Romosozumab
AAV-CAG-GFP
AAV-ScFv (anti-GFP)-DKK1cF234K-Flag-His
AAV-18R5-DKK1c-FlagHis

** P value <0.05
**** P value <0.000.1

FIG. 24A-C
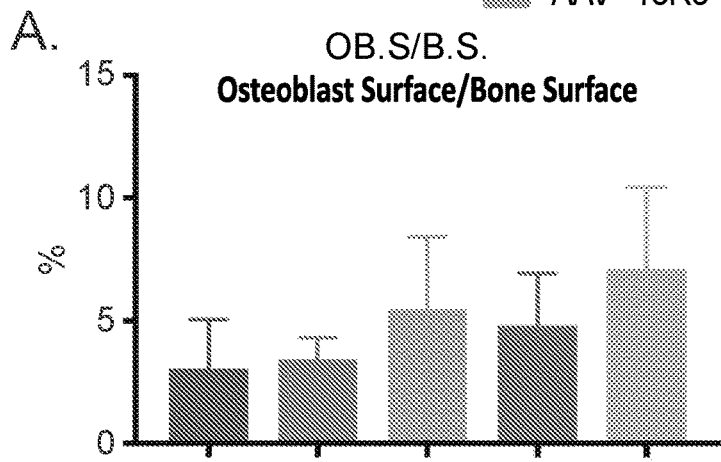
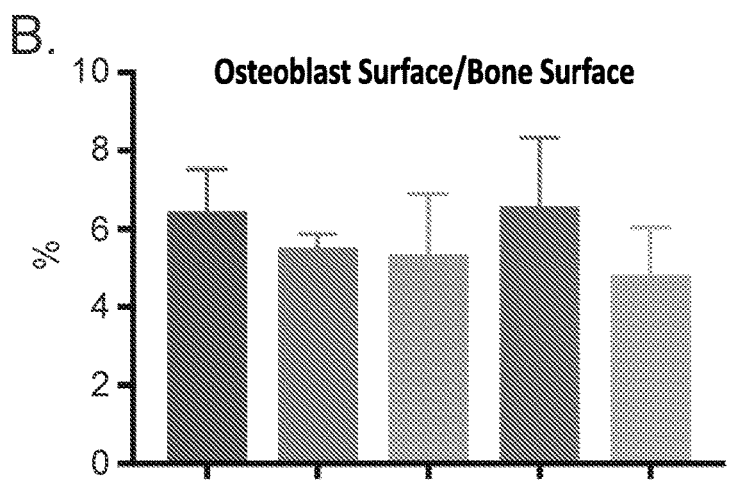
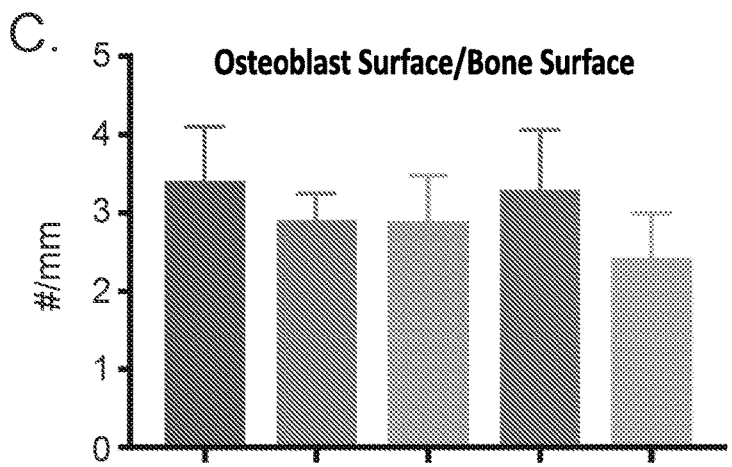

FIG. 24D
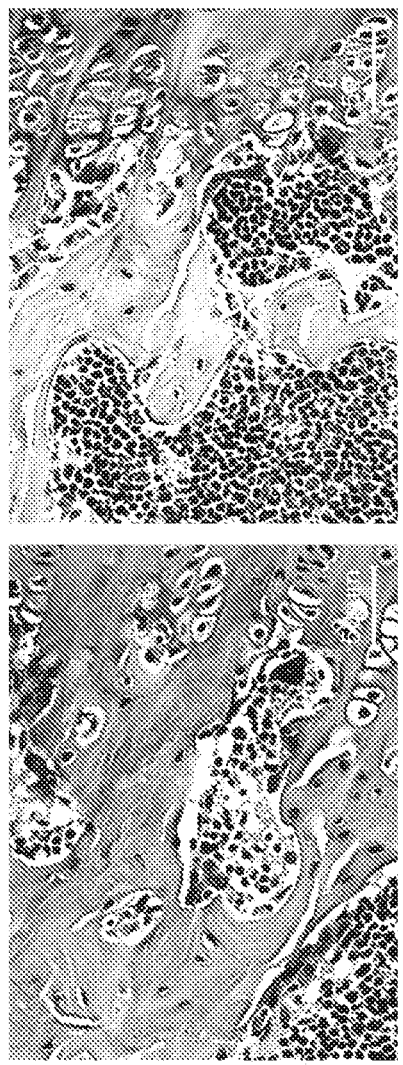
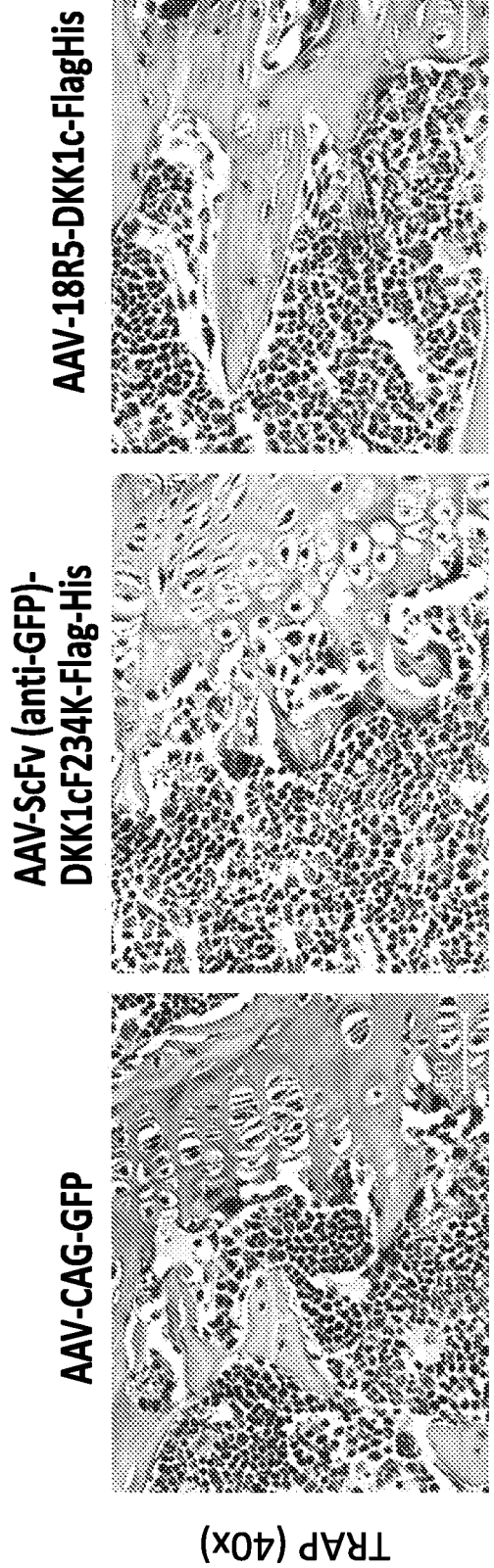

**P value <0.05

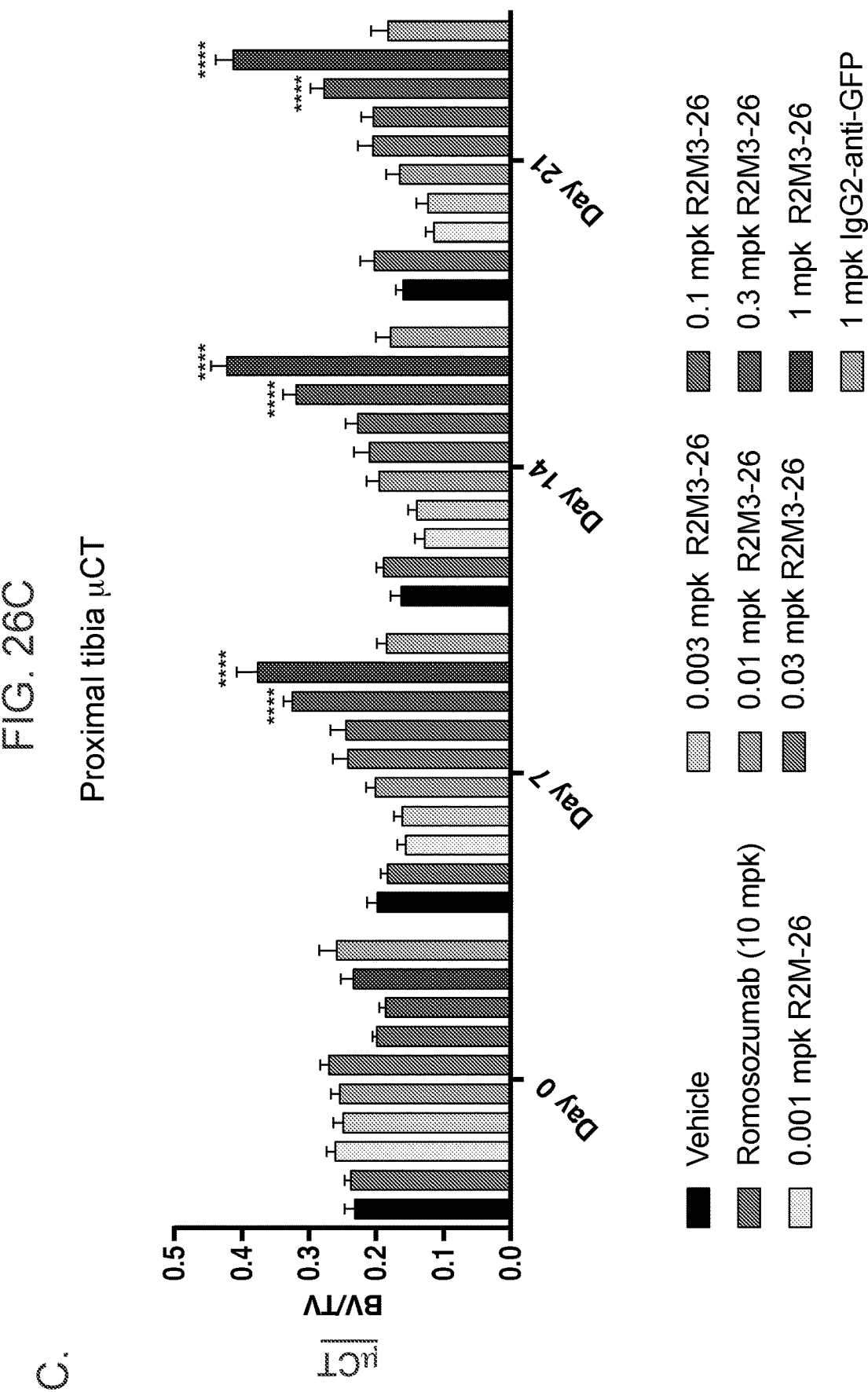
FIG. 26C Proximal tibia μCT

FIG. 26D
D.
Vehicle    1 mpk R2M3-26
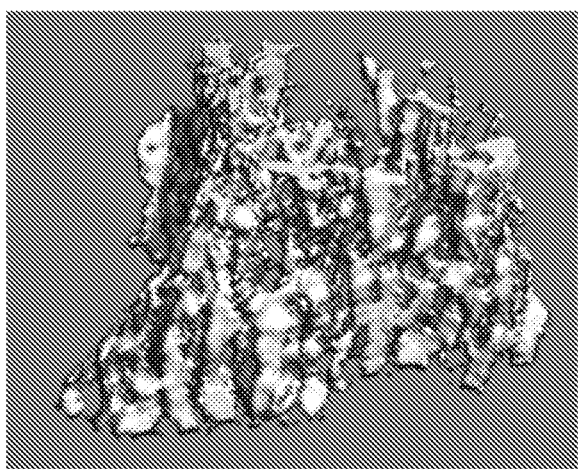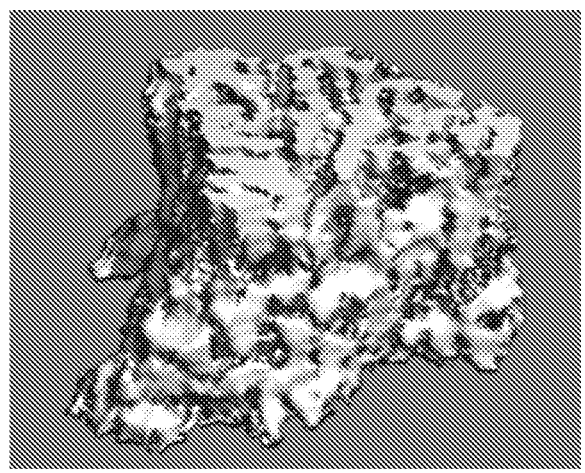

*P value <0.05
** P value <0.0001    Compared to OVX + Veh

- Vehicle (PBS)
- Romososzumab (30 MPK)
- R2M3-26 (1MPK)
- R2M3-26 (10 MPK)
- 1R-CO7-26 (1 MPK)
- 1R-CO7-26 (5 MPK)
- 1R-CO7-26 (10 MPK)
- Anti-GFP (1 MPK)

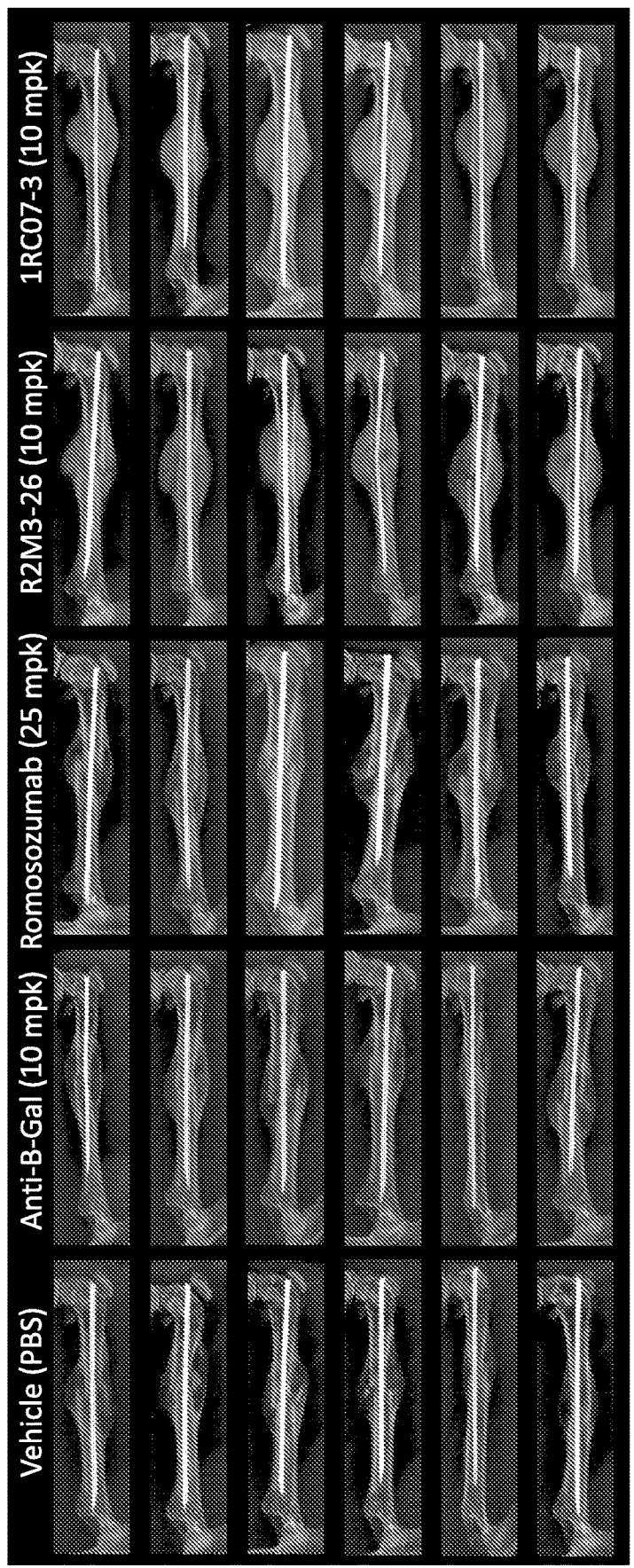
FIG. 33A  1 week of treatment

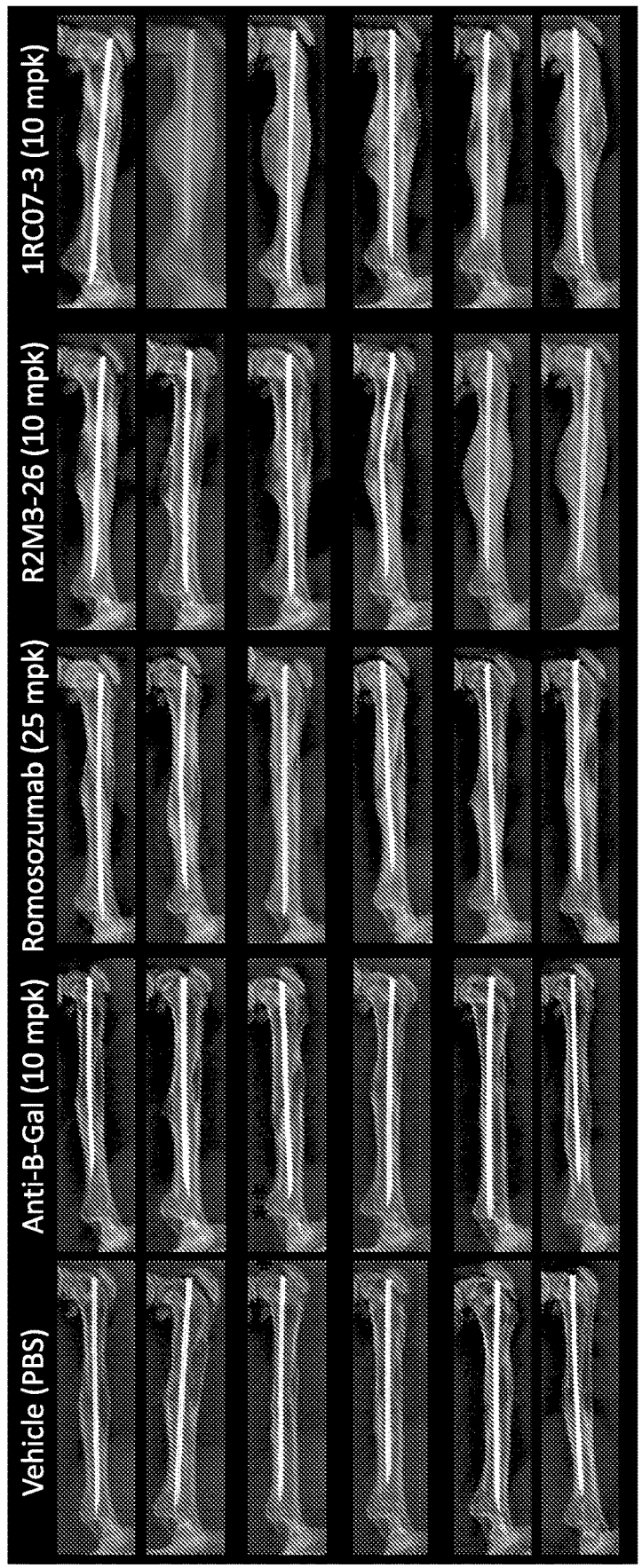
FIG. 33B  6 week of treatment

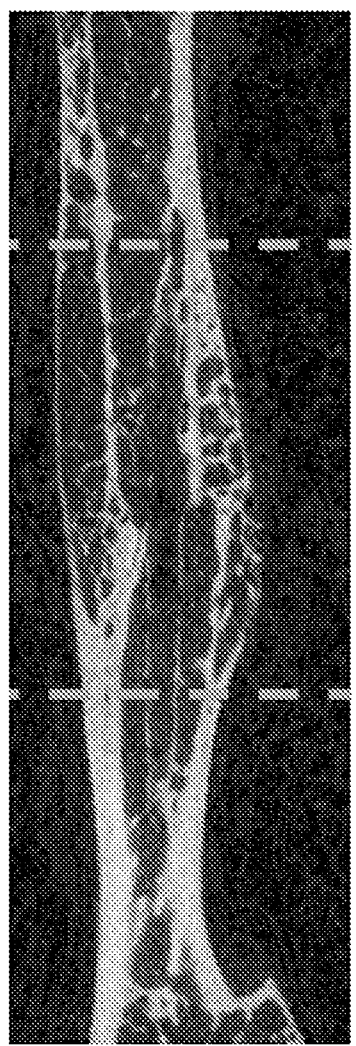
FIG. 33D
400 SLICES, 4.2 MM
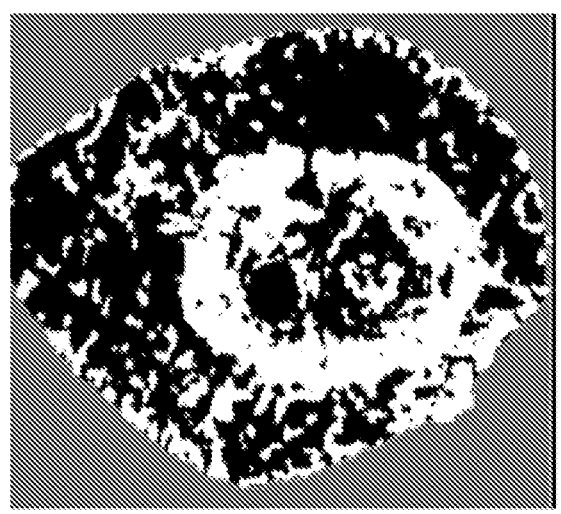
Bone area
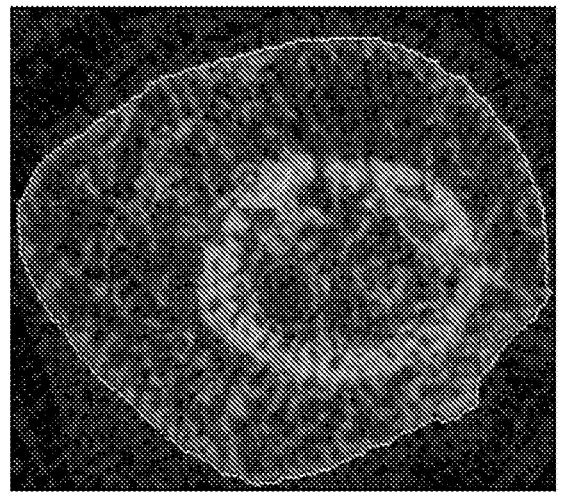
Tissue area FIG. 33D (contd.)
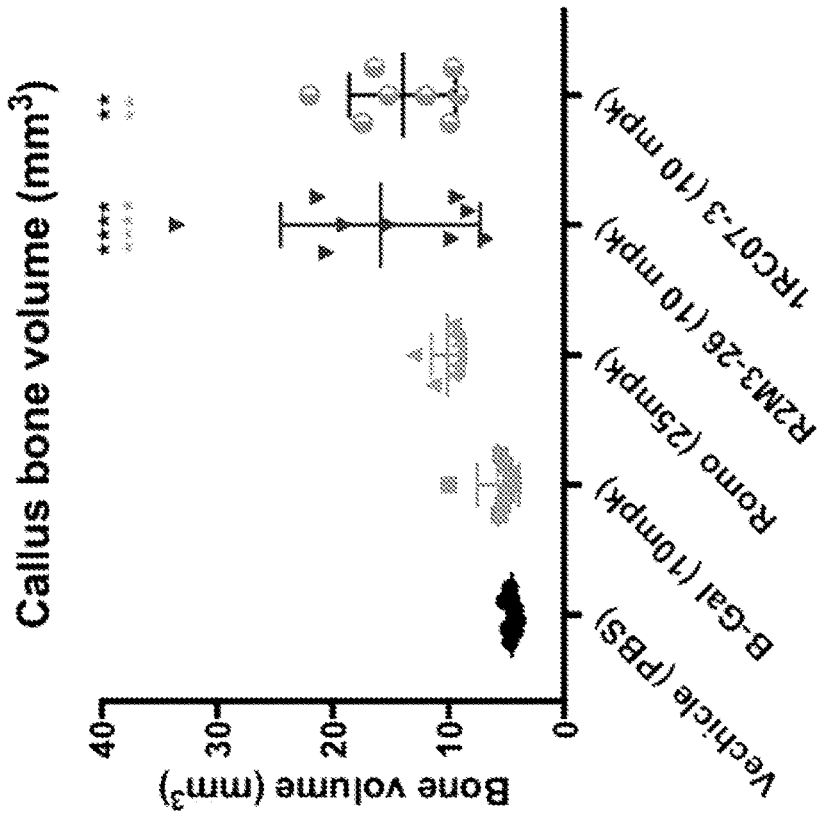
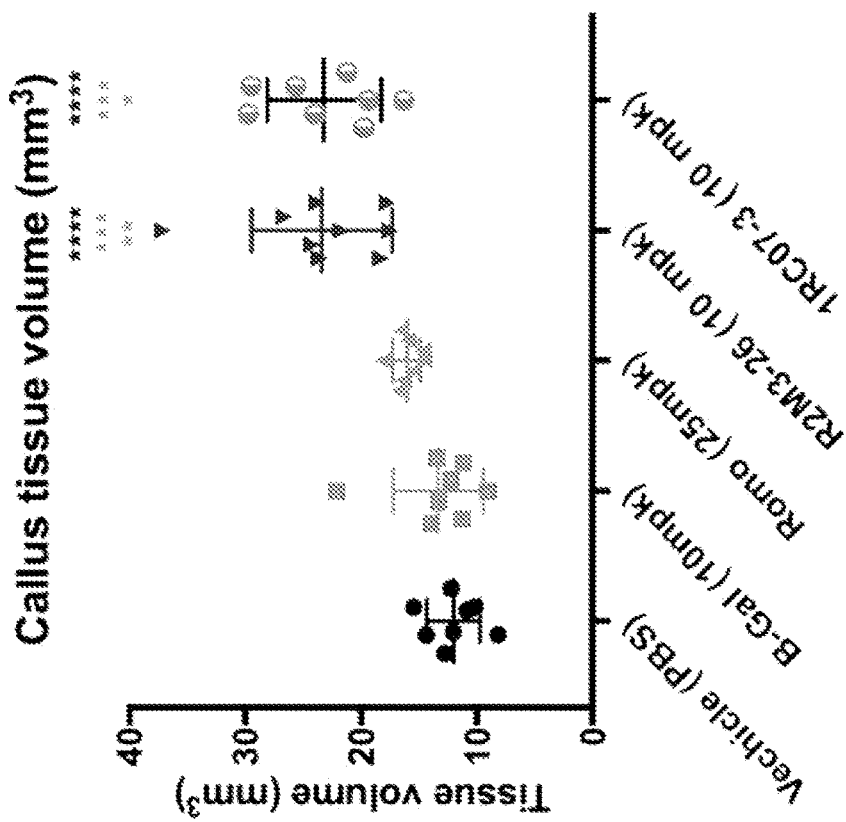

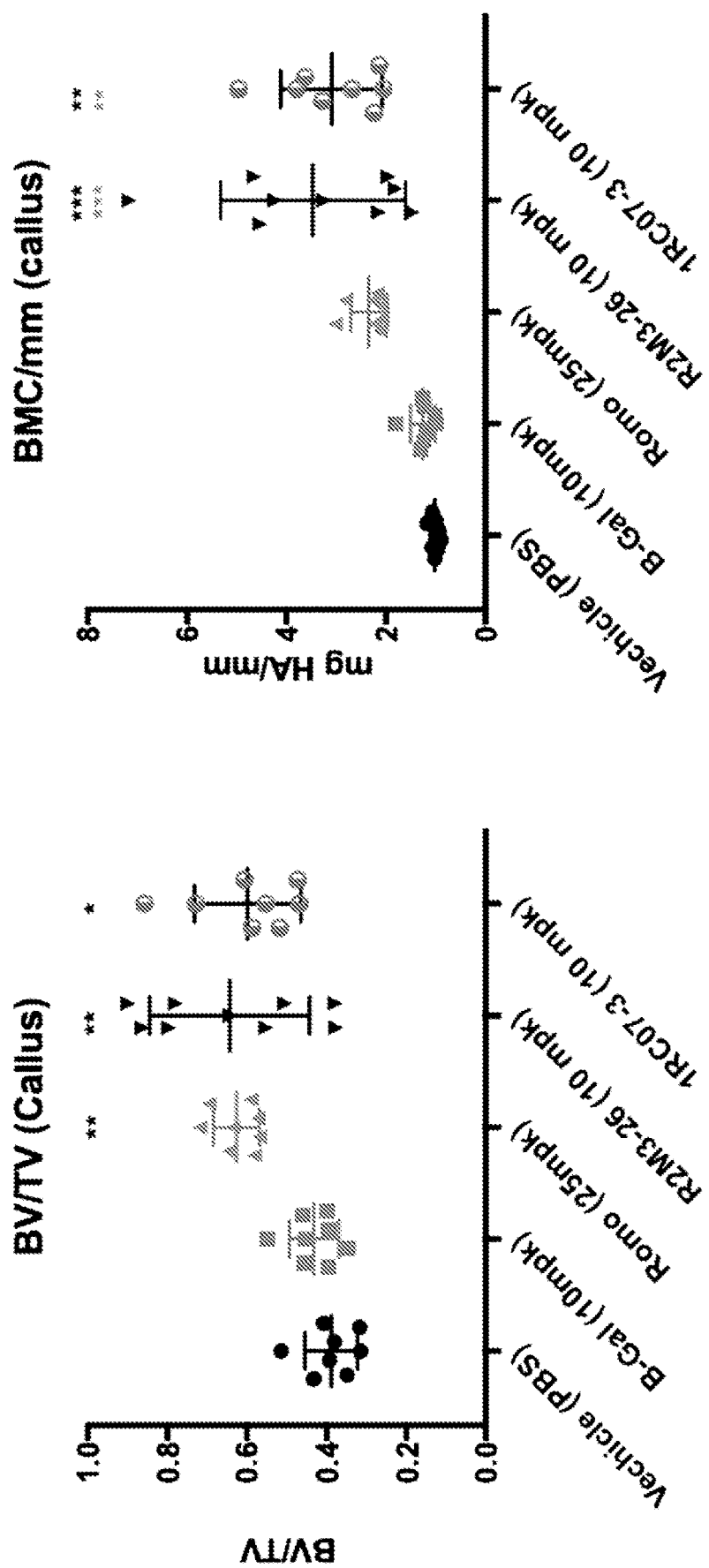
FIG. 33D (contd.)

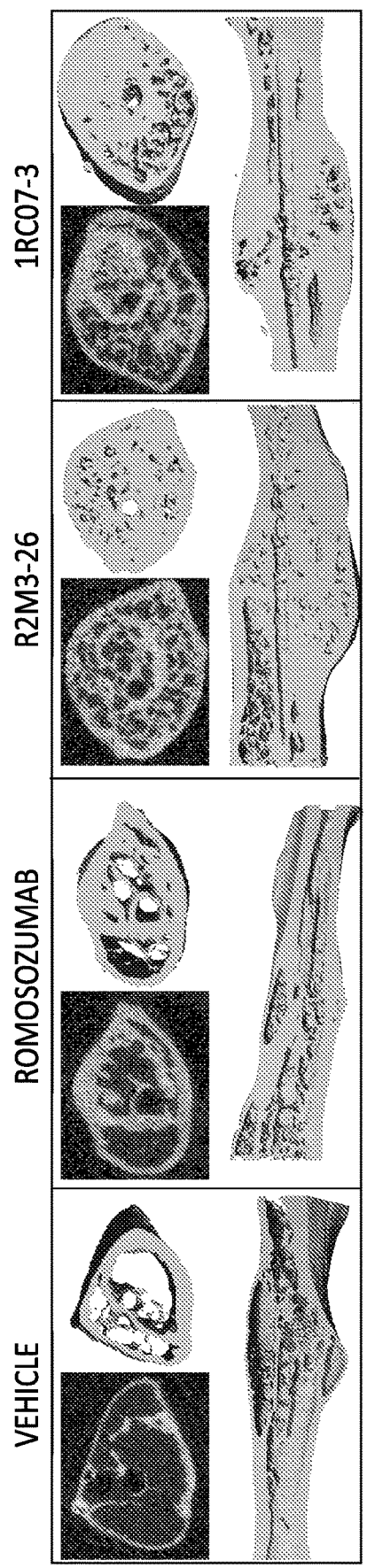
FIG. 33D (contd.)

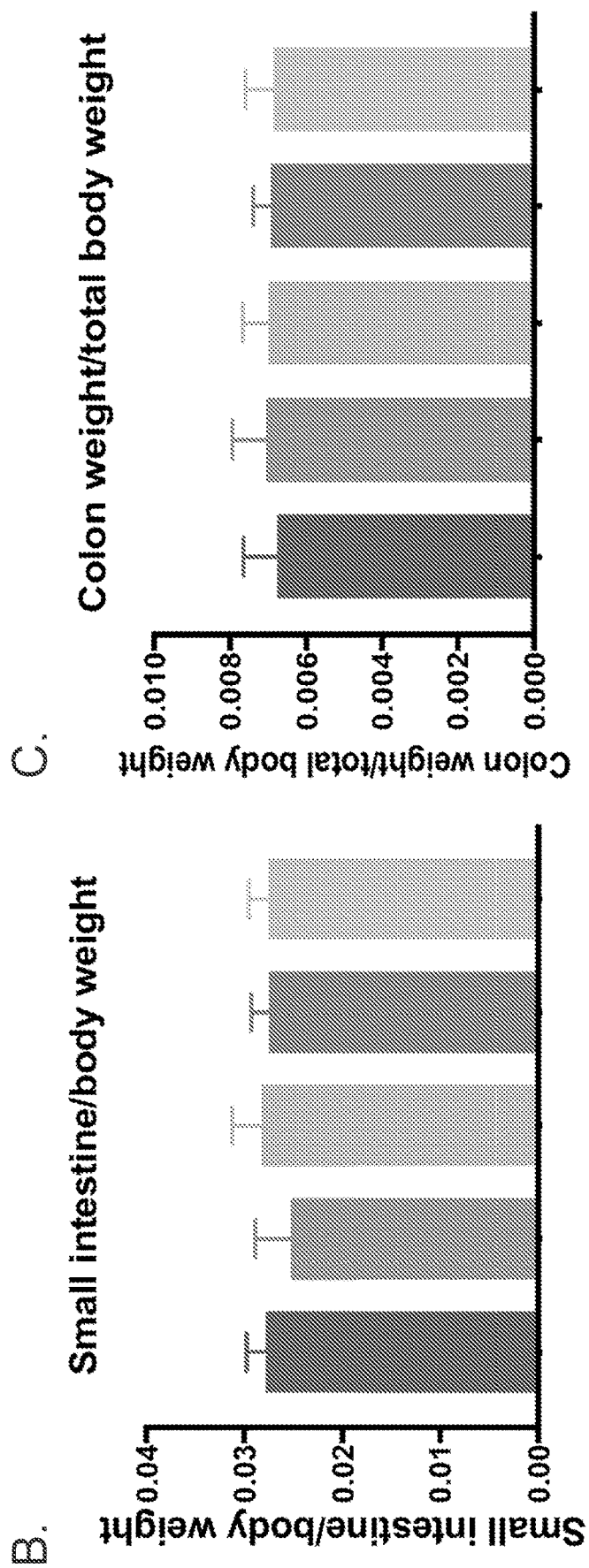
FIG. 37 (contd.)

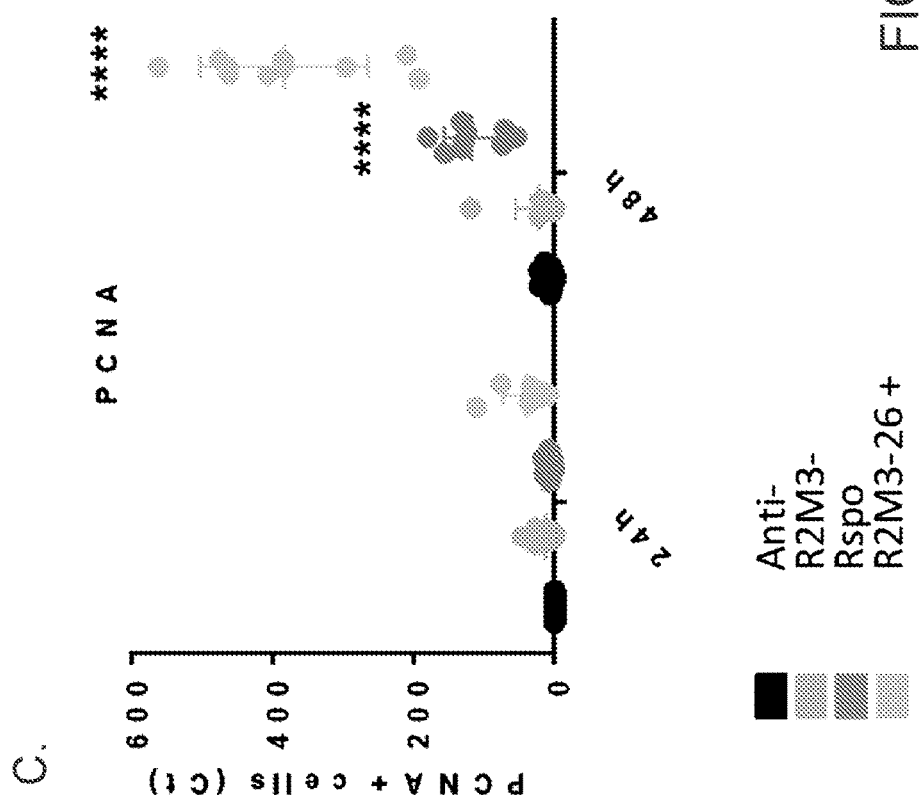
FIG. 39 (contd.)

A.

B.

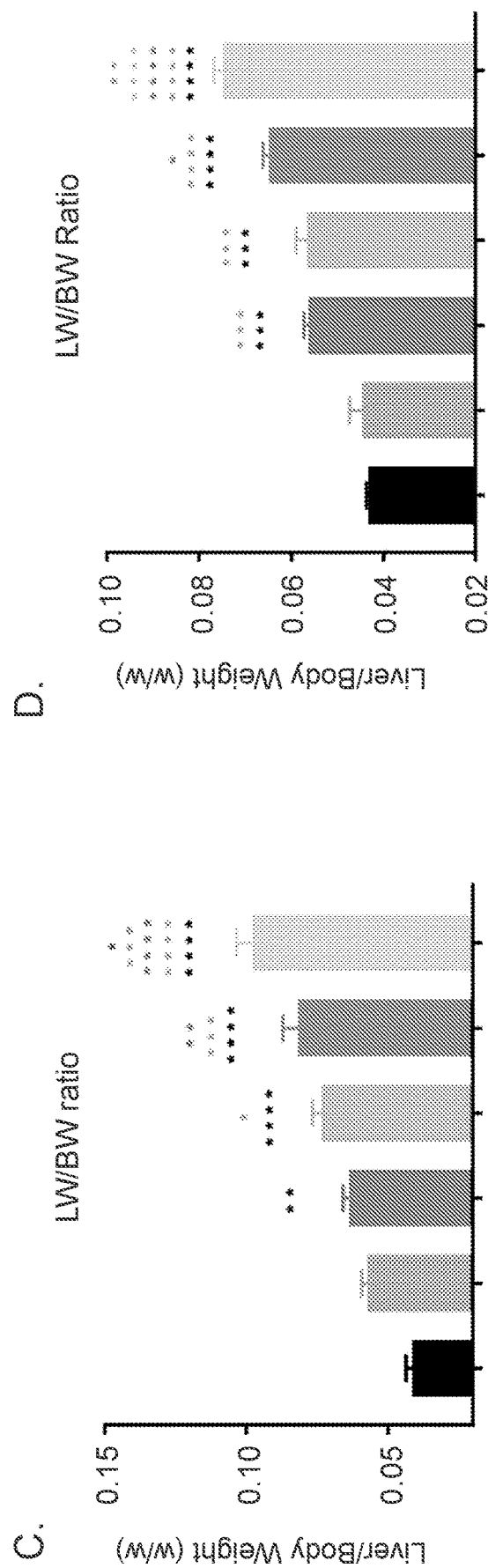
FIG. 40 (contd.)

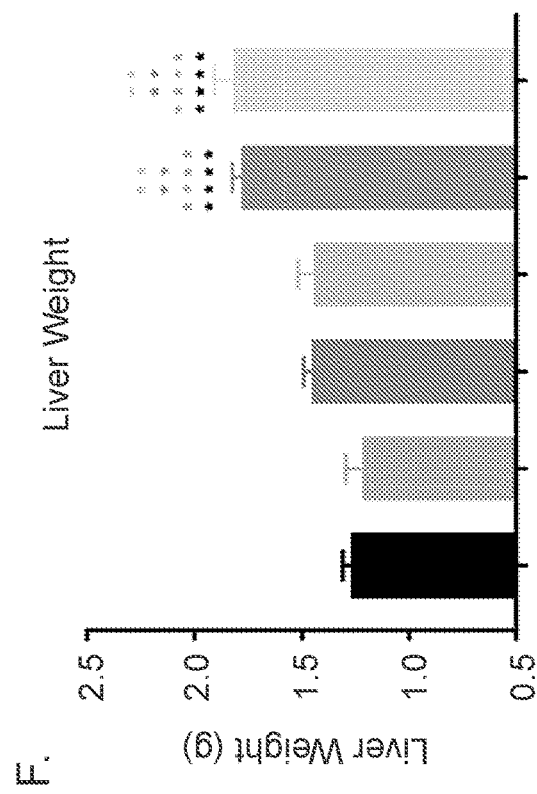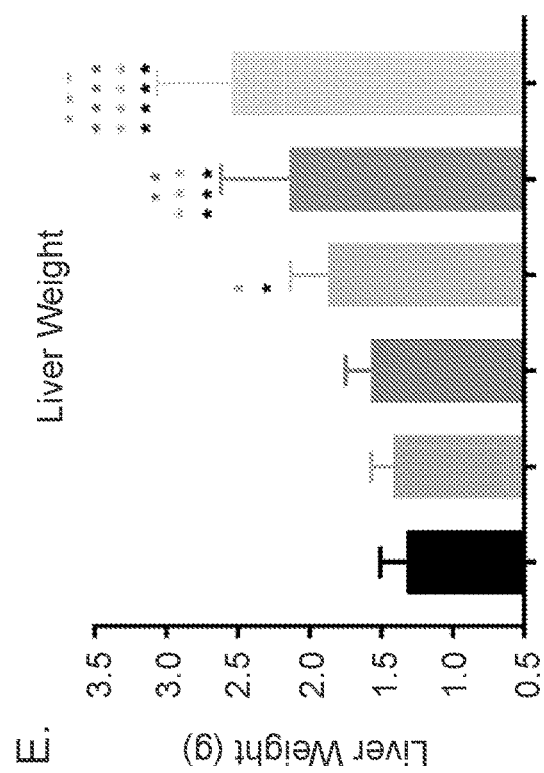
FIG. 40 (contd.)

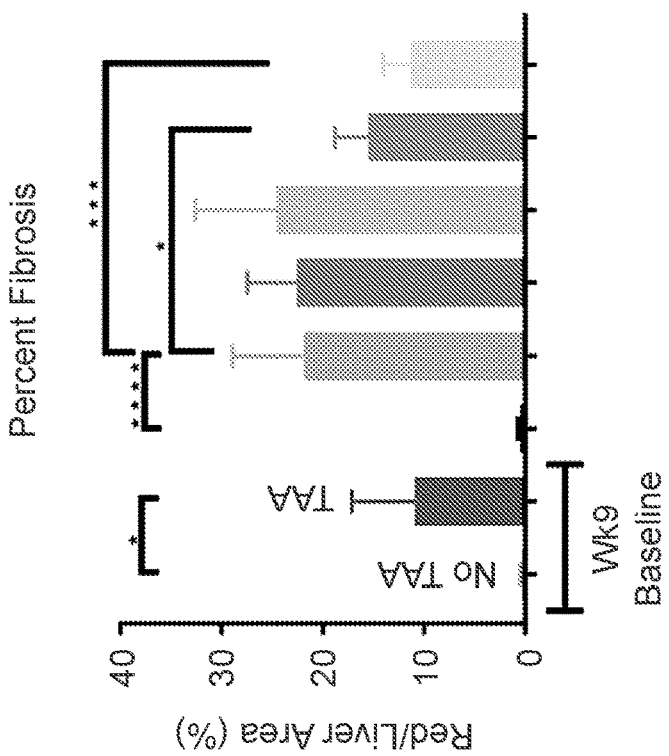
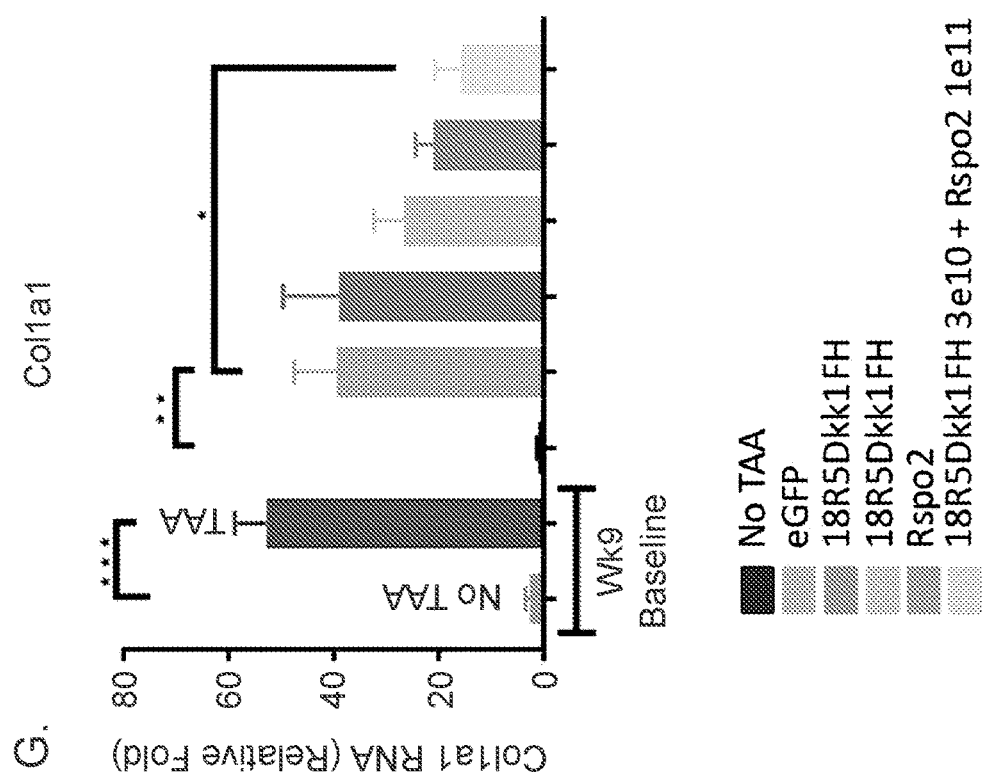
FIG. 40 (contd.)

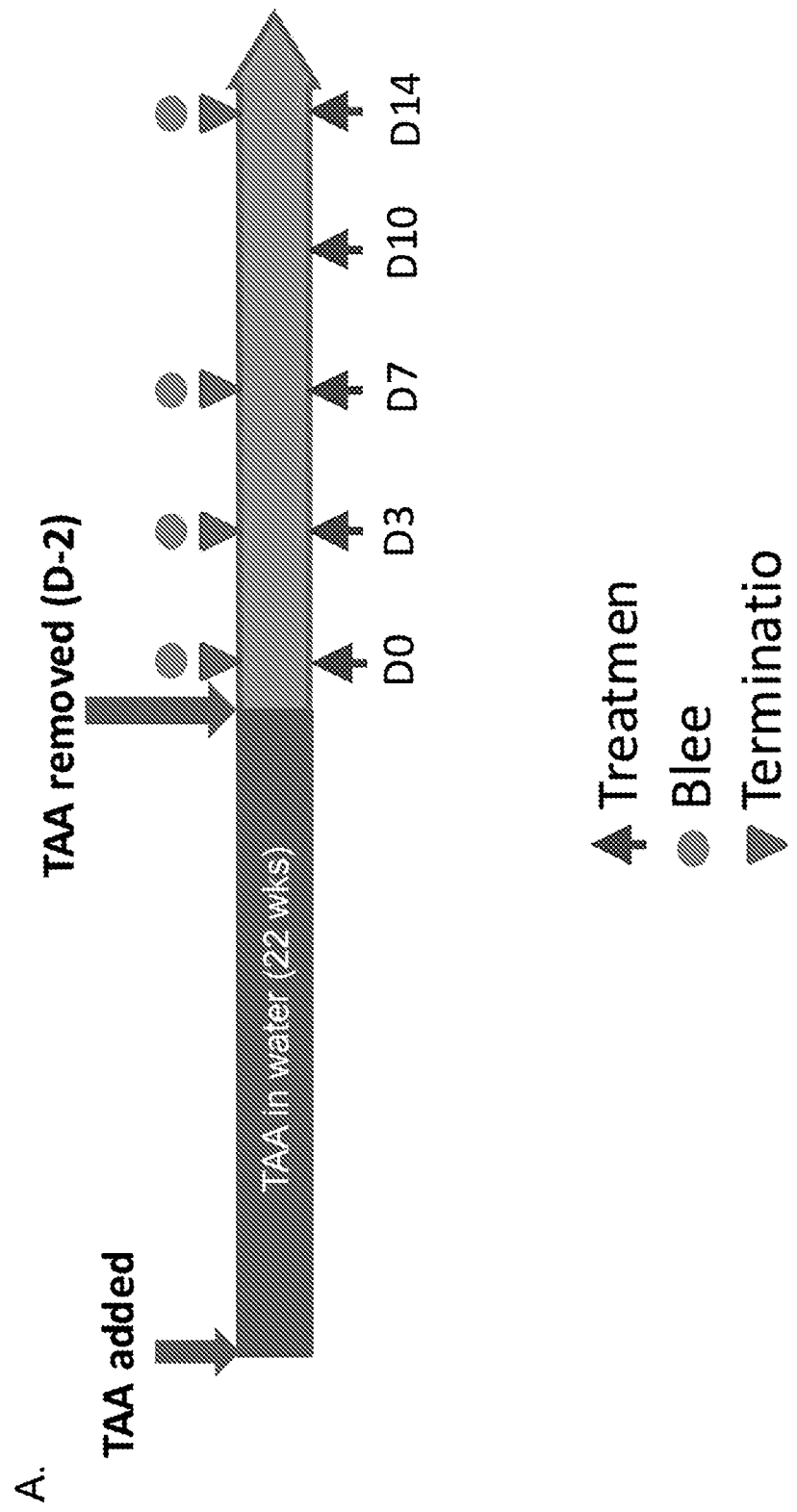

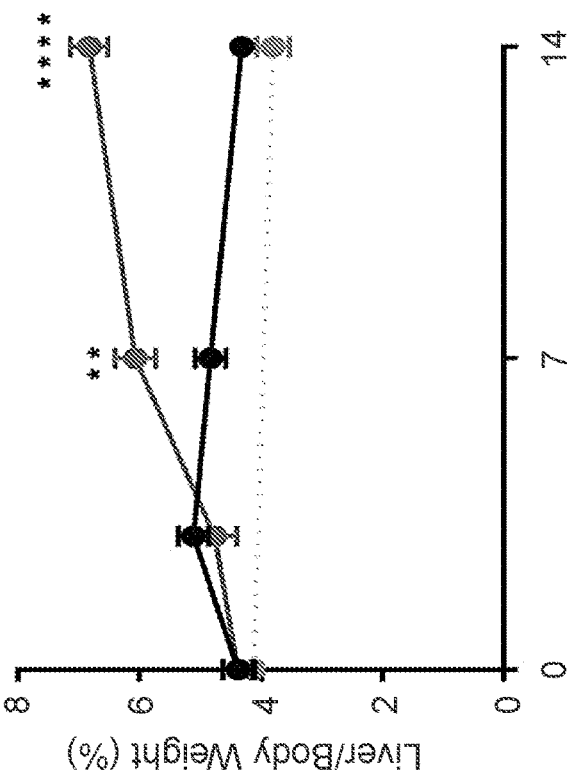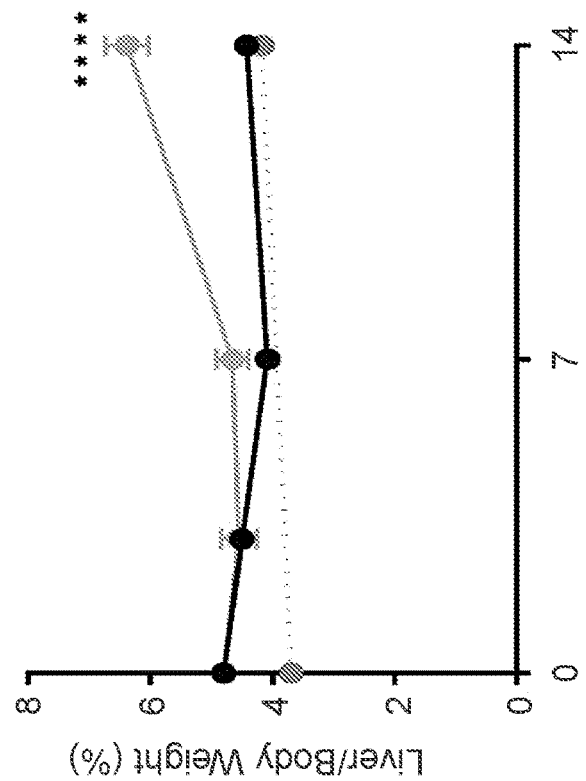
FIG. 41 (contd.)

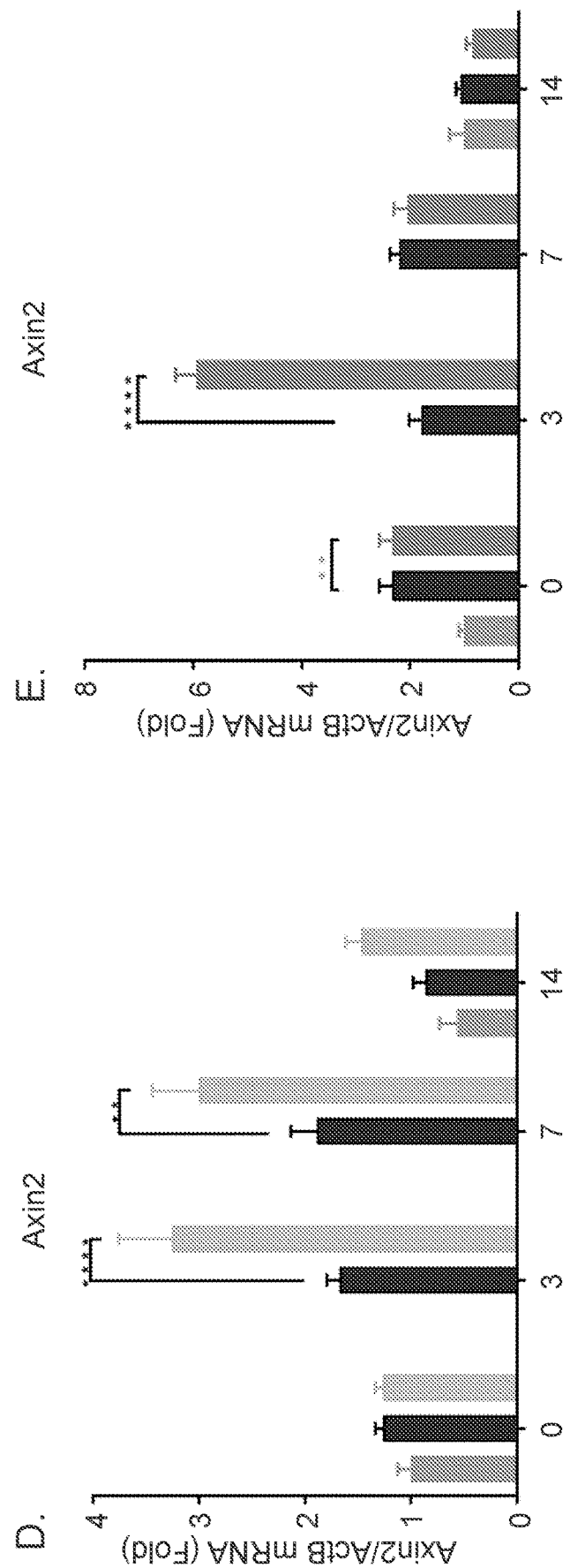
FIG. 41 (contd.)

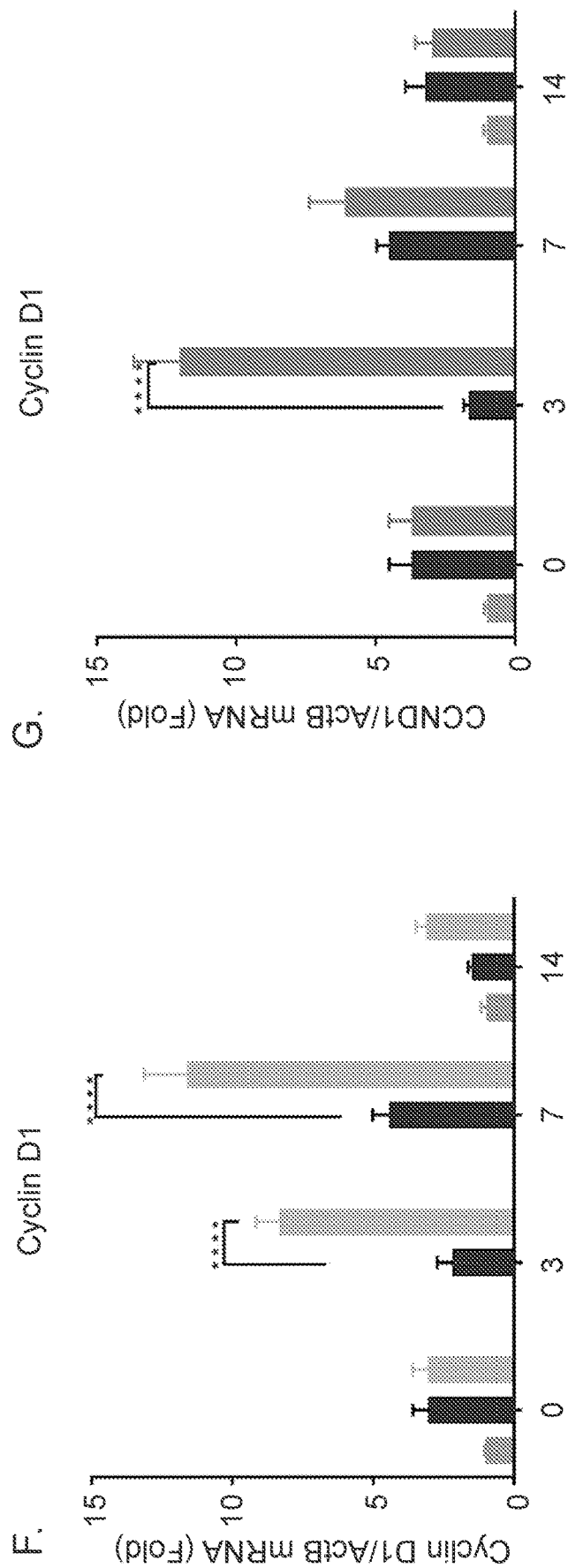
FIG. 41 (contd.)

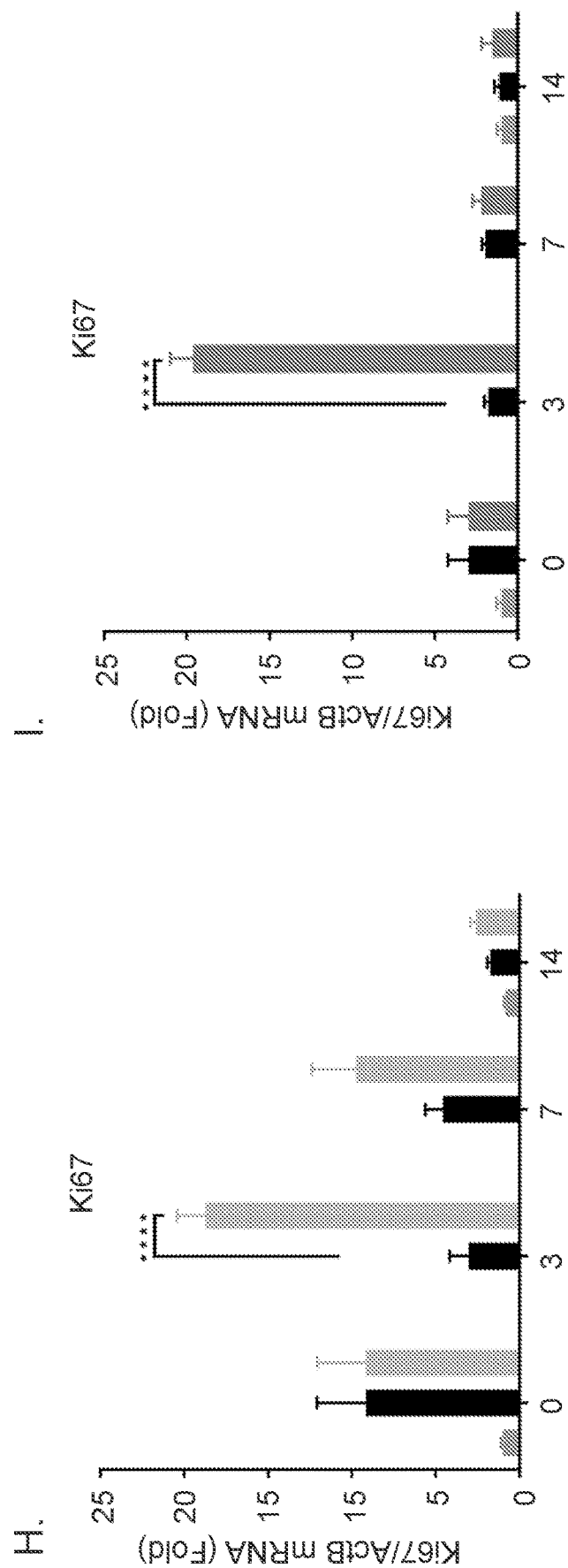
FIG. 41 (contd.)

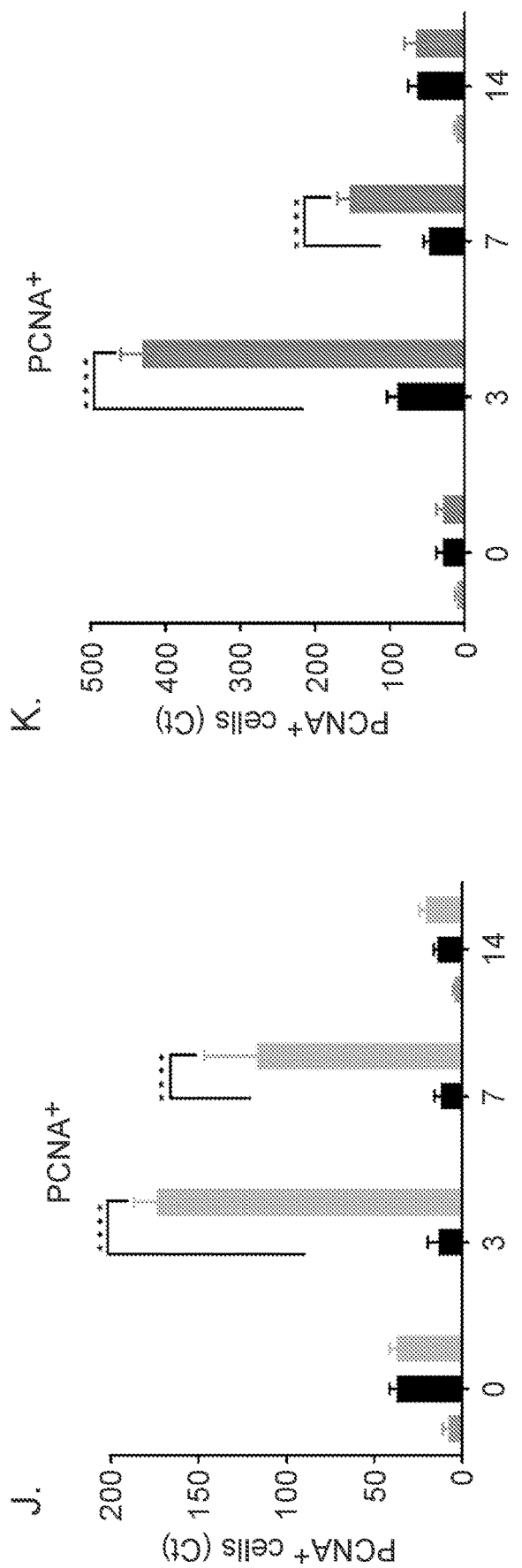
FIG. 41 (contd.)

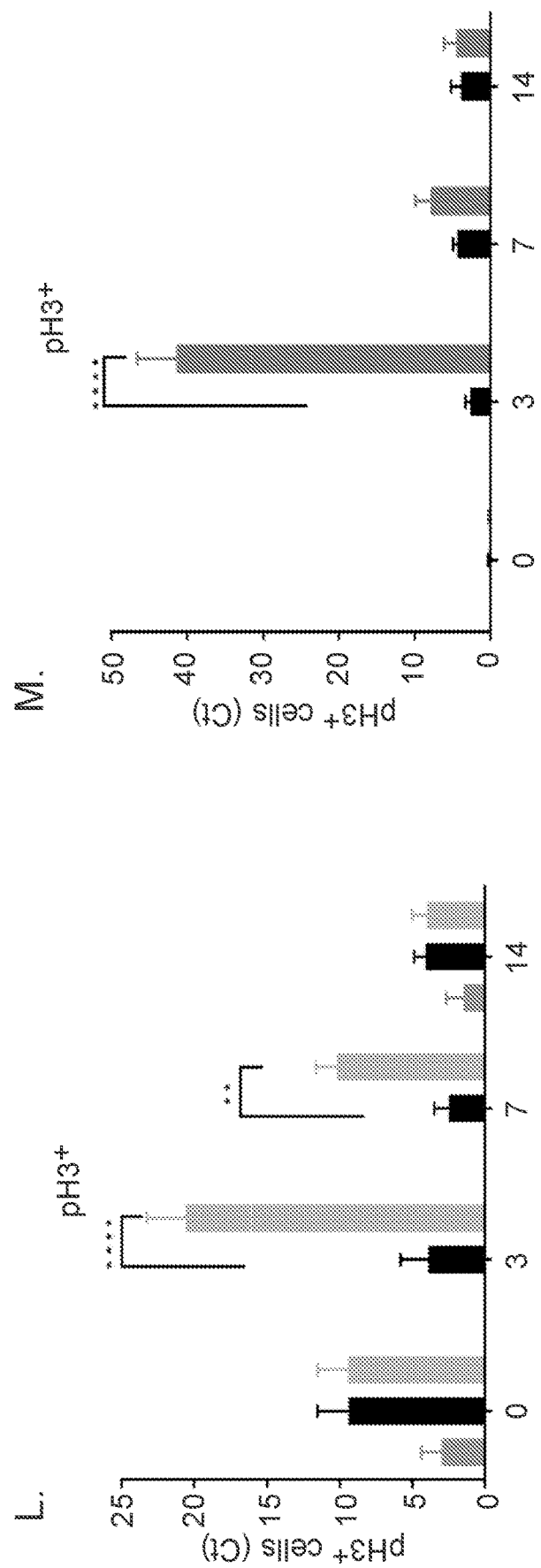
FIG. 41 (contd.)

FIG. 42 (contd.)
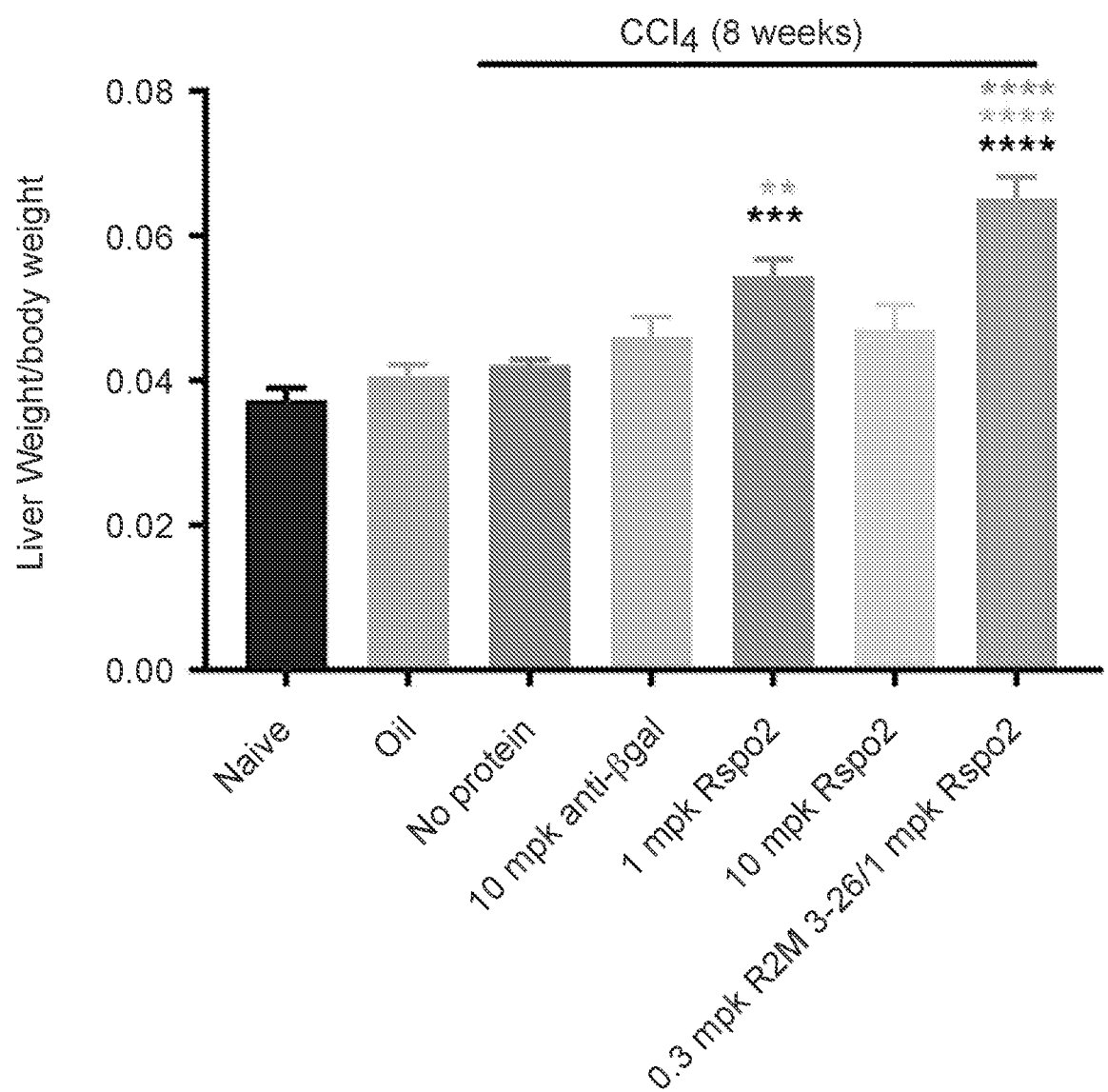

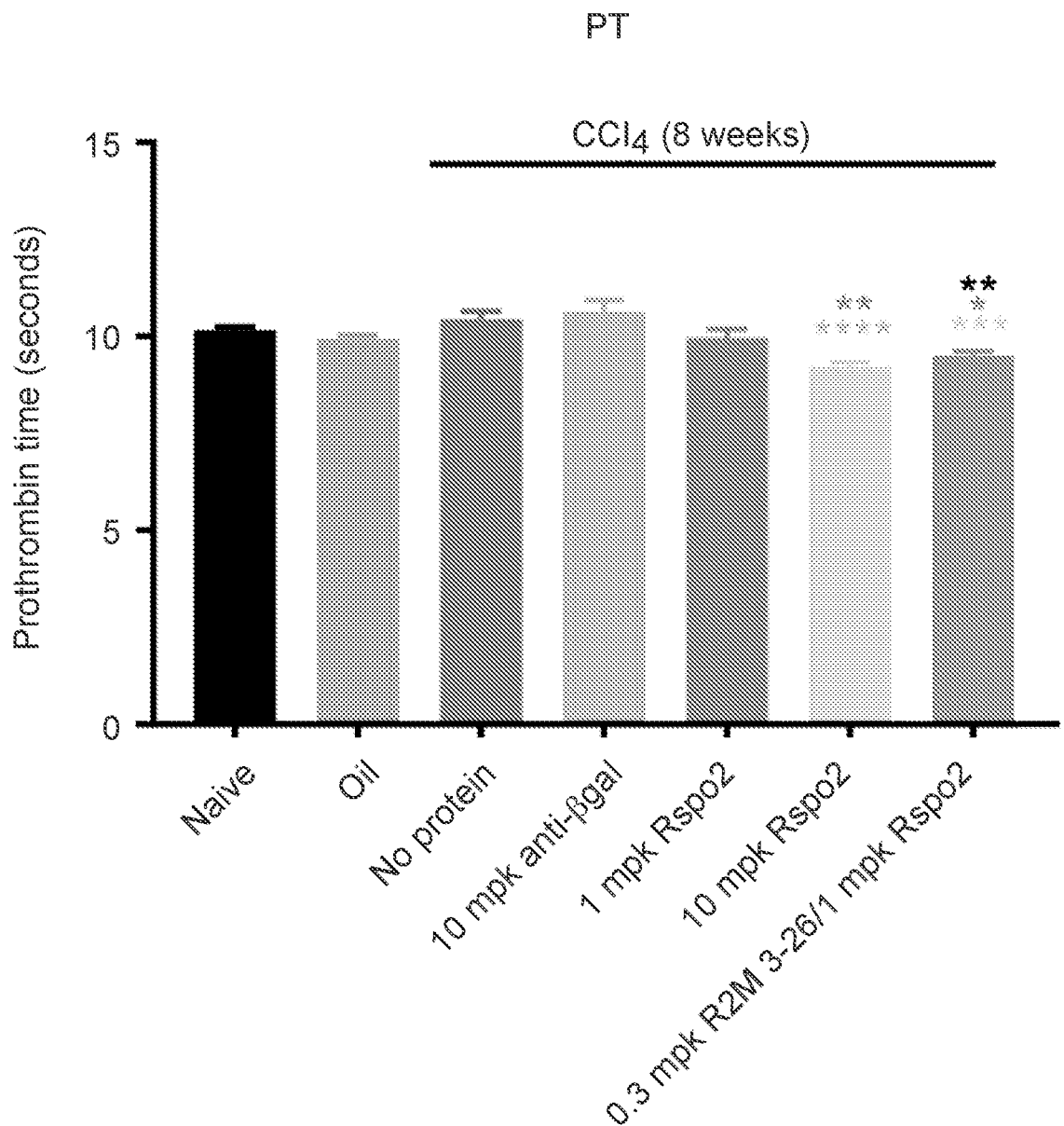
FIG. 42 (contd.)

FIG. 42 (contd.)
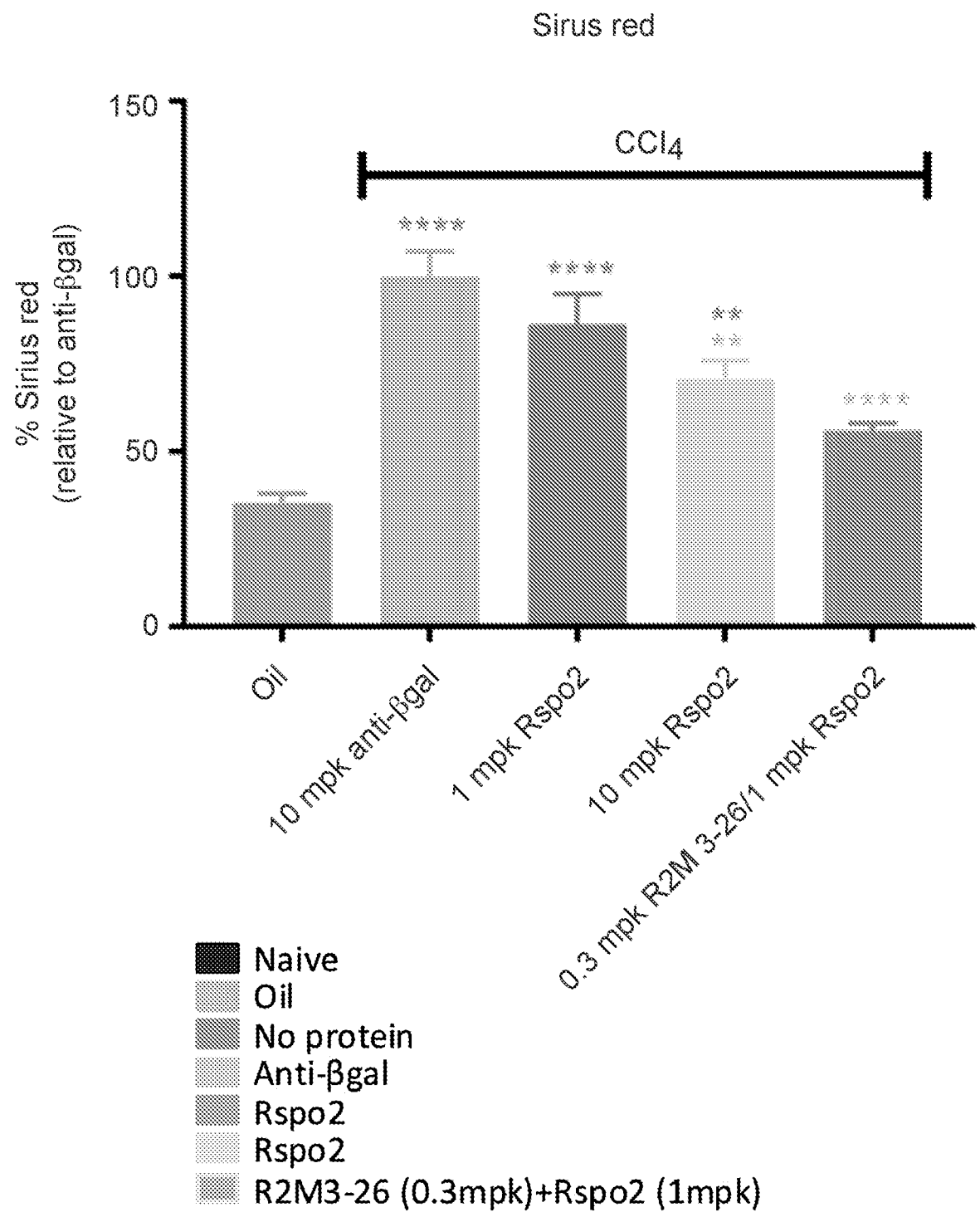

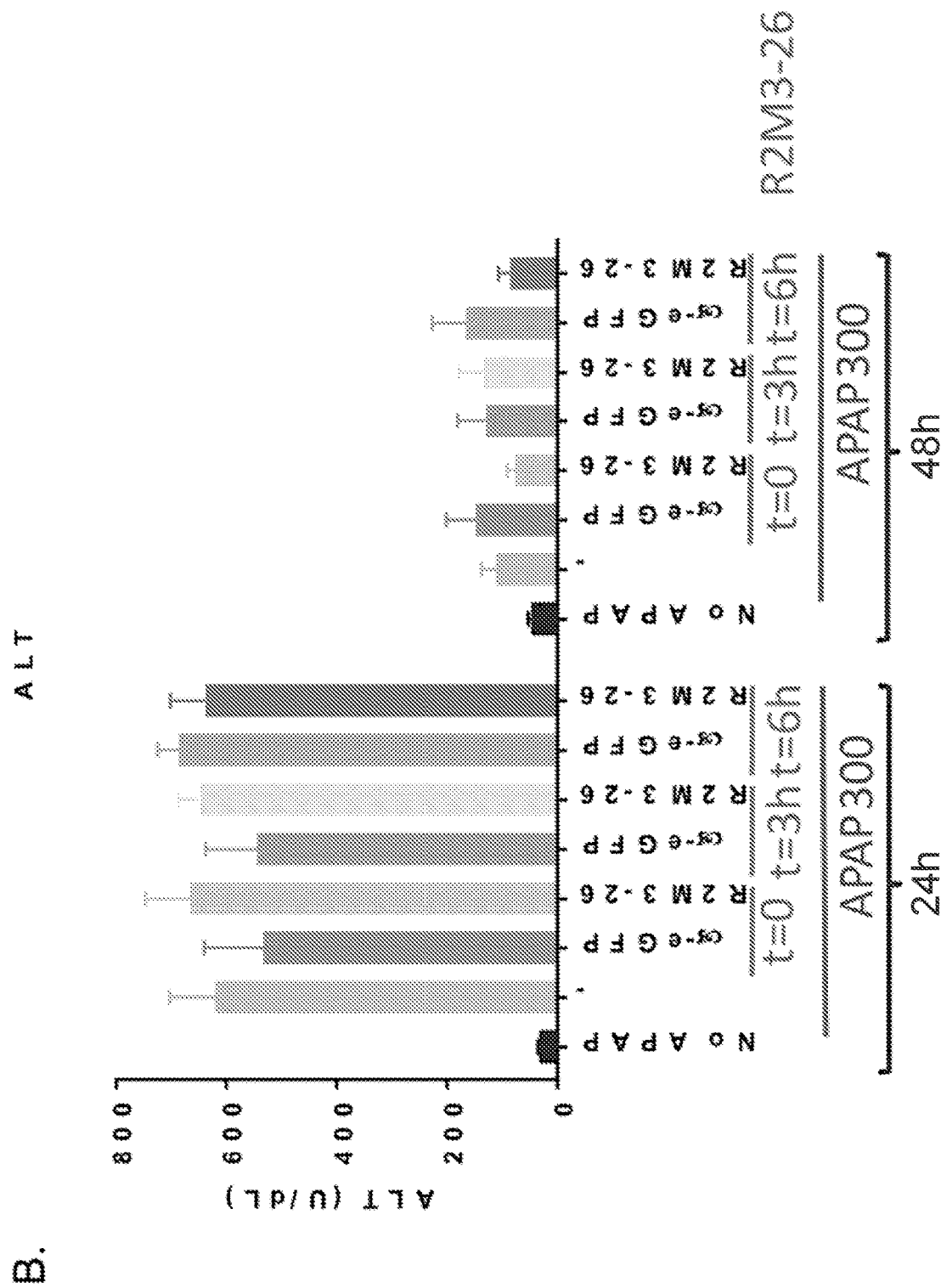
FIG. 43 (contd.)

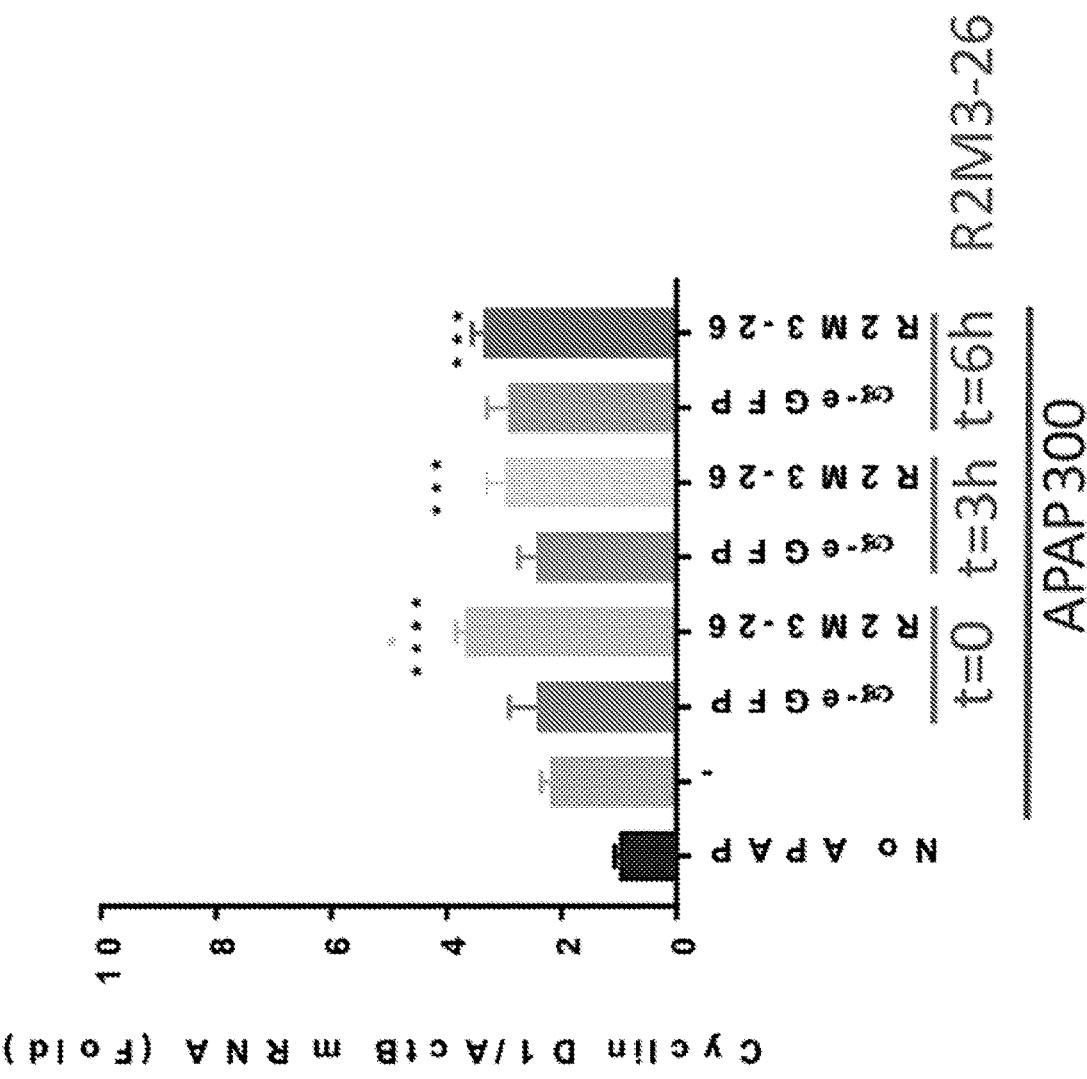
FIG. 43 (contd.)

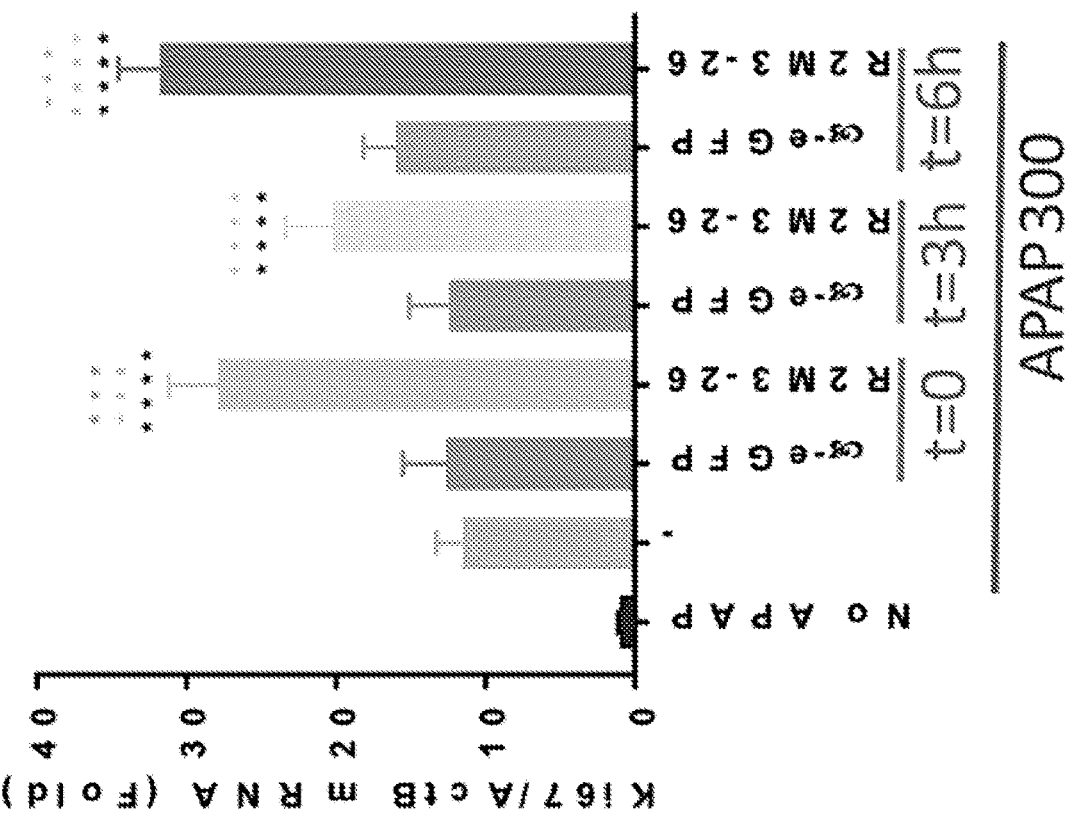
FIG. 43 (contd.)

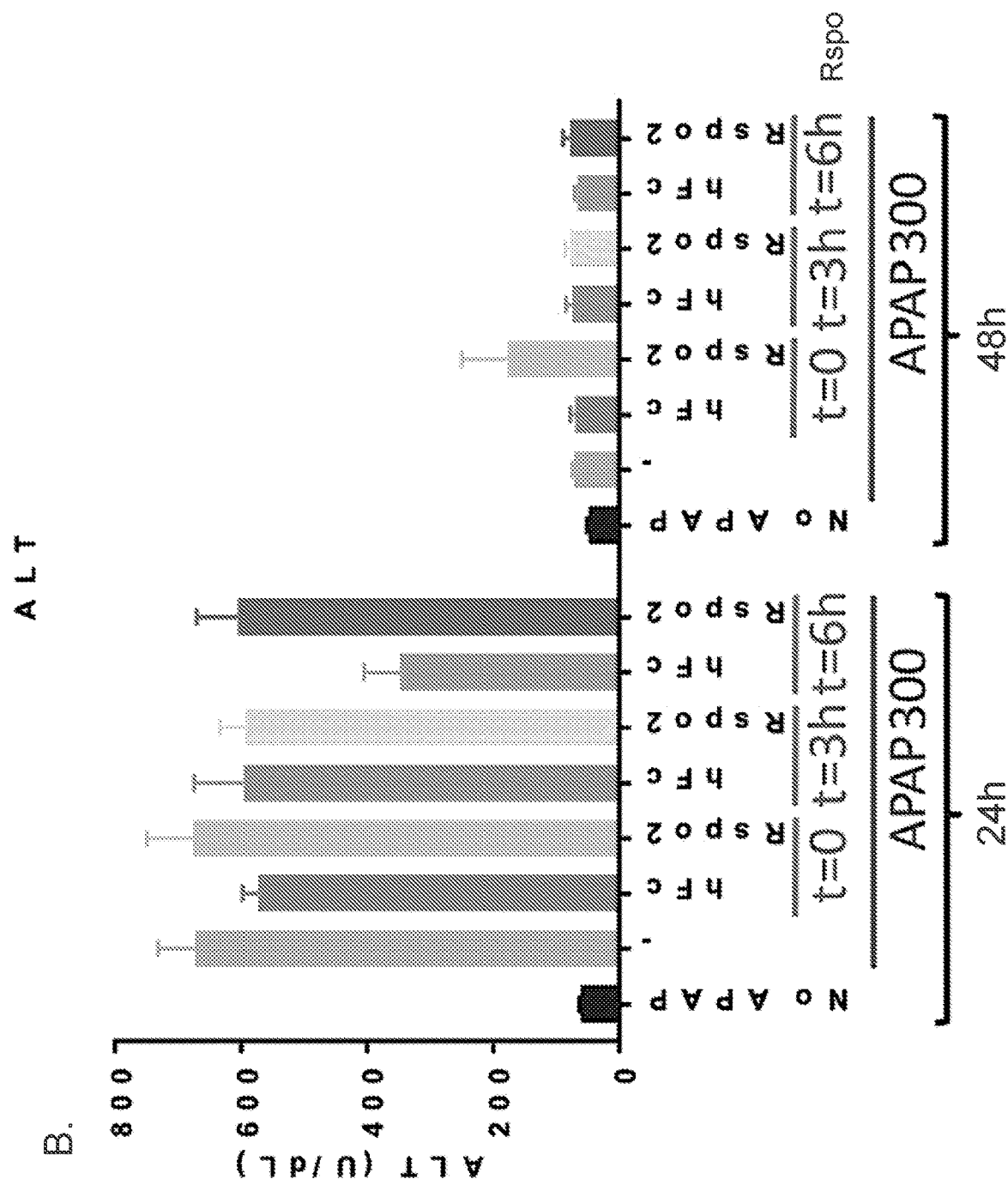
FIG. 44 (contd.)

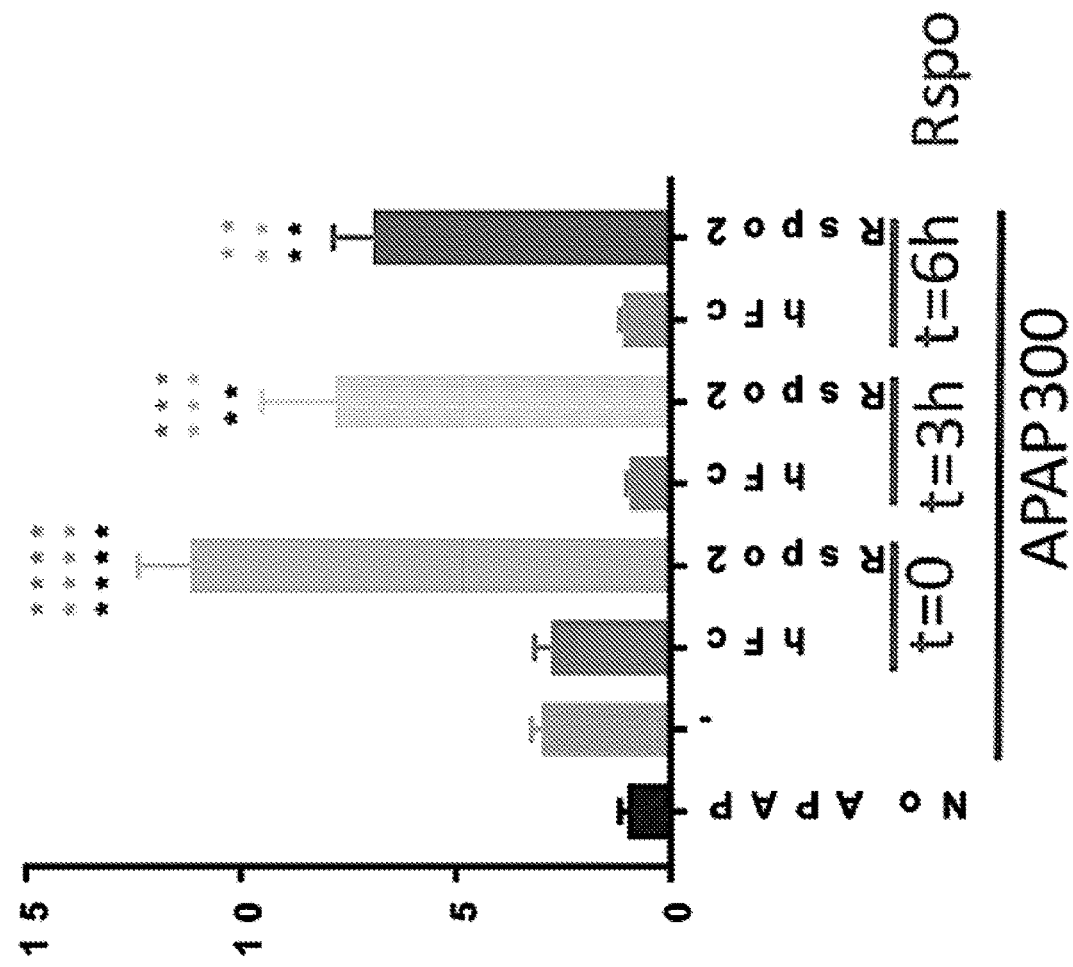
FIG. 44 (contd.)

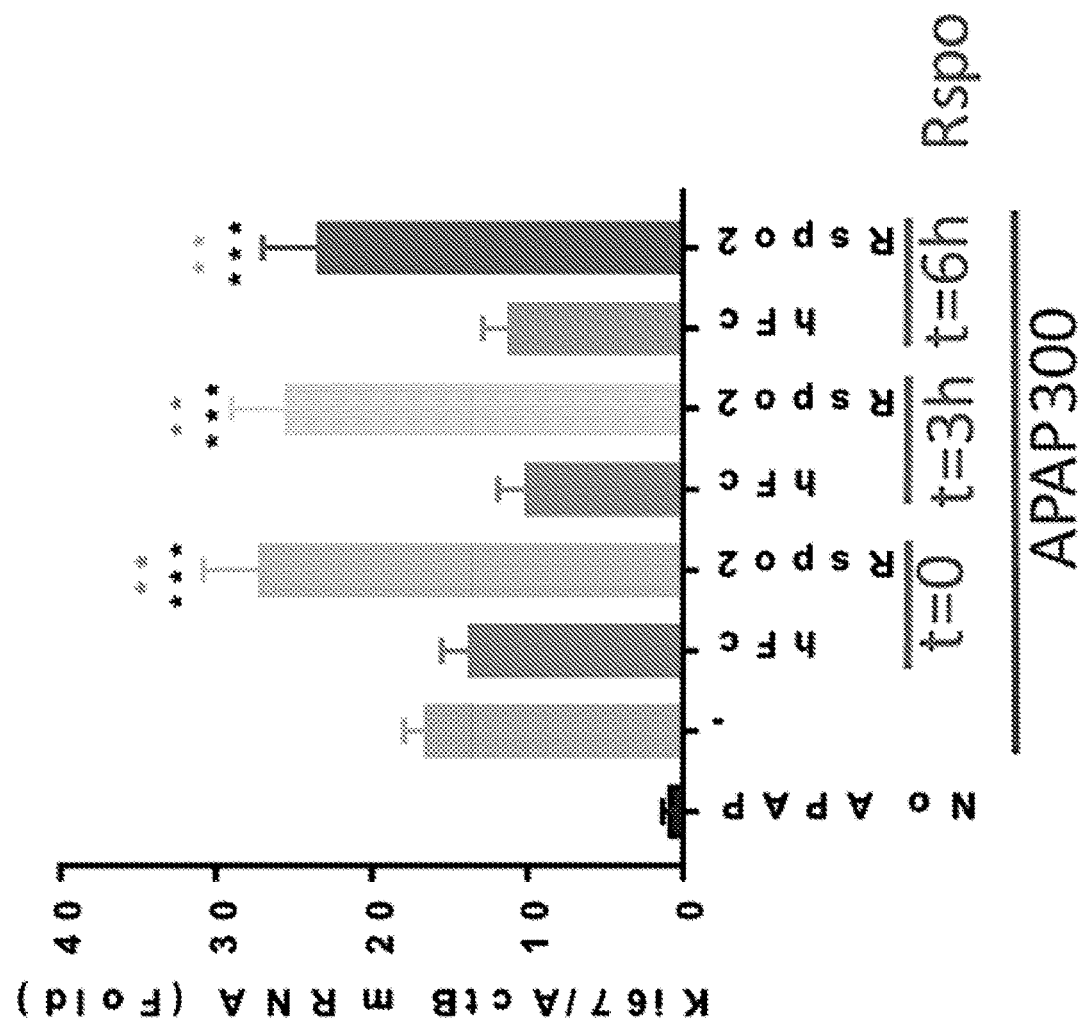
FIG. 44 (contd.)

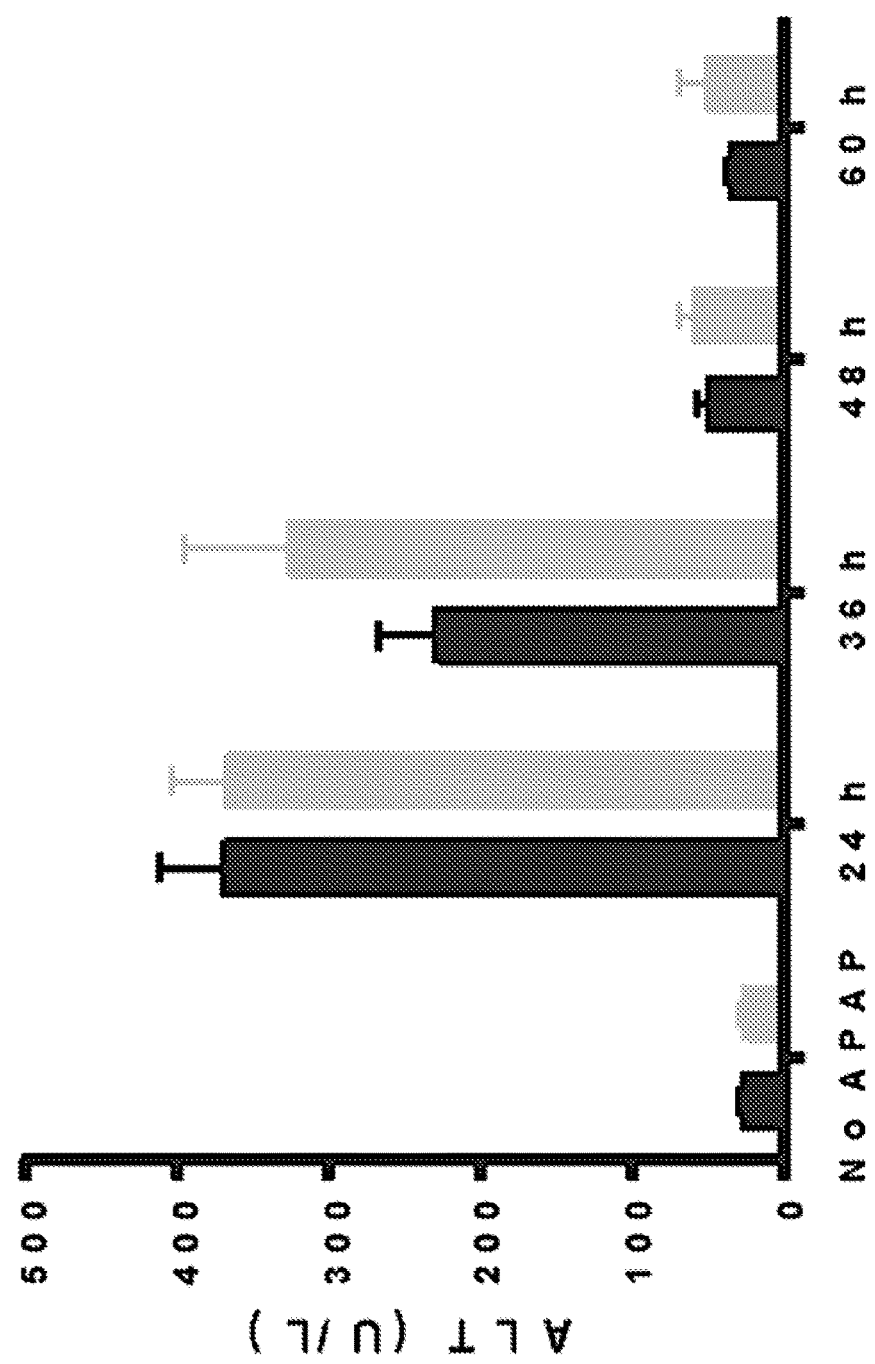
FIG. 45 (contd.)

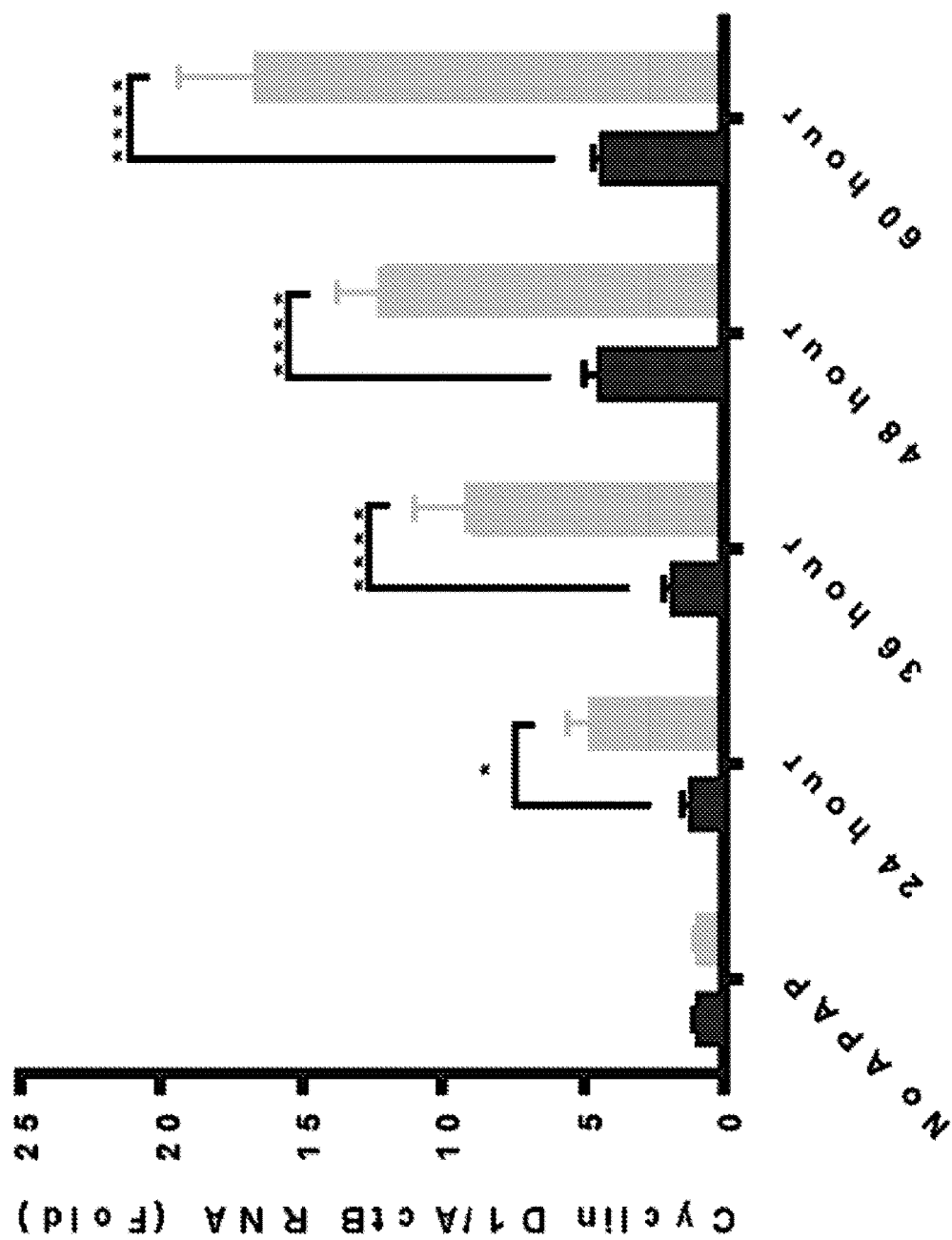
FIG. 45 (contd.)

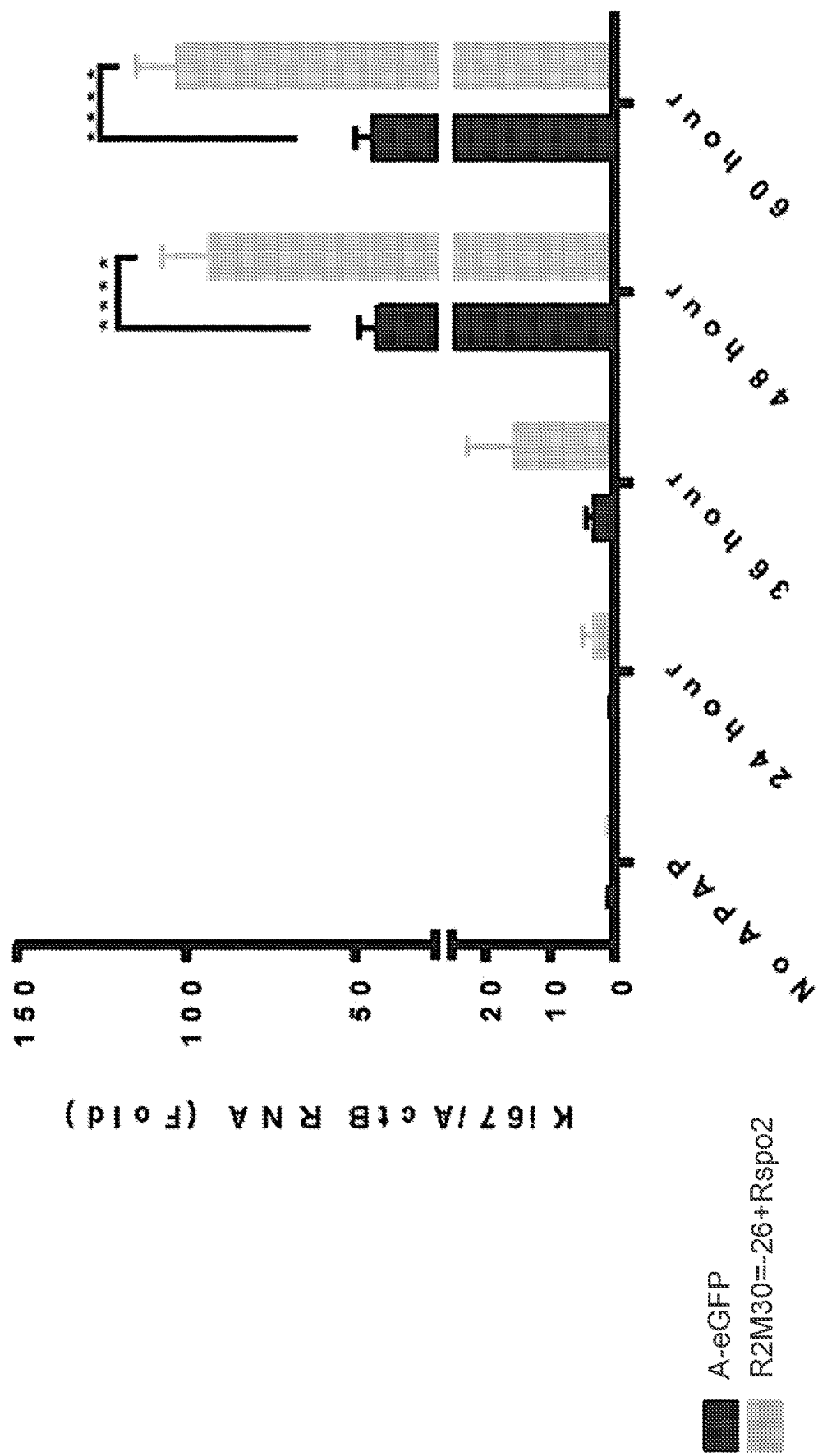
FIG. 45 (contd.)

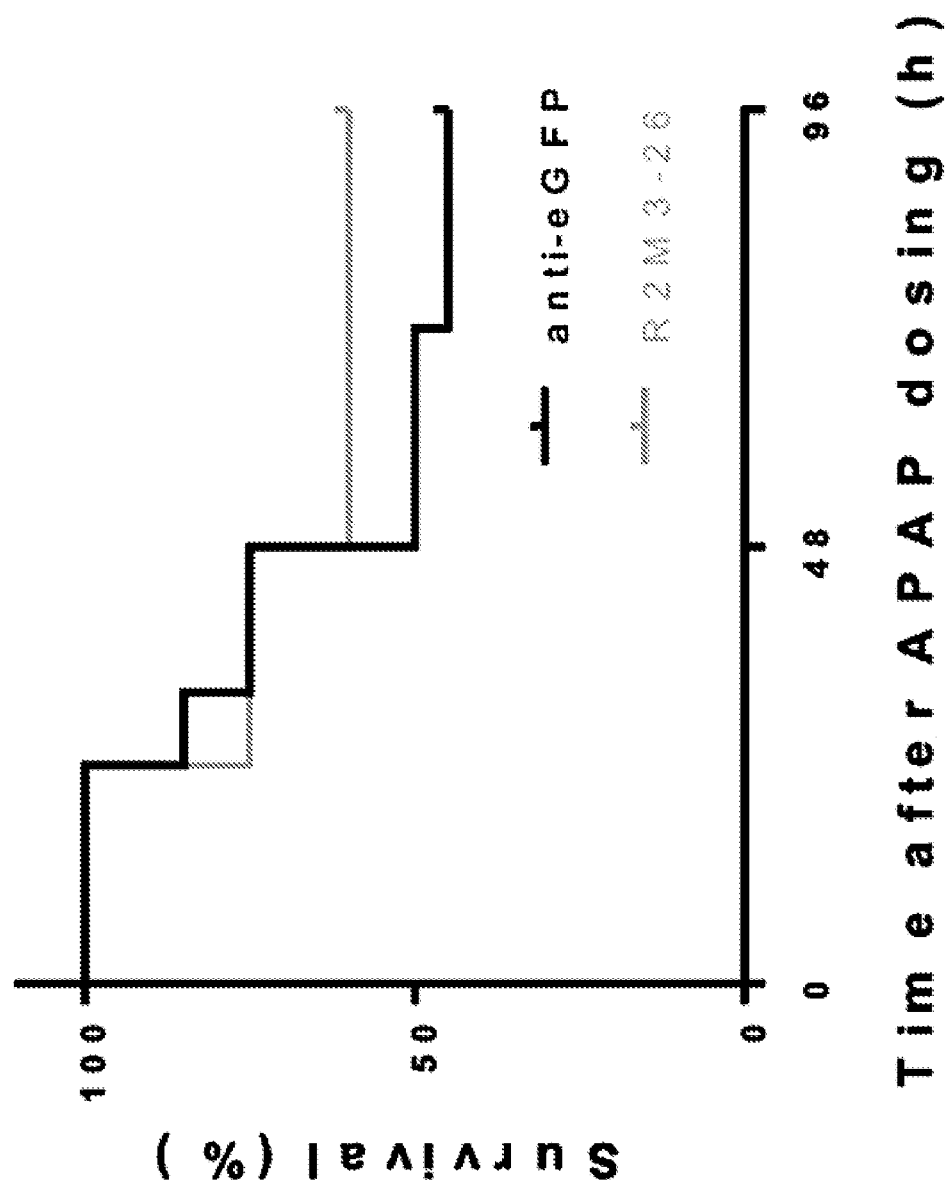
FIG. 46 (contd.)

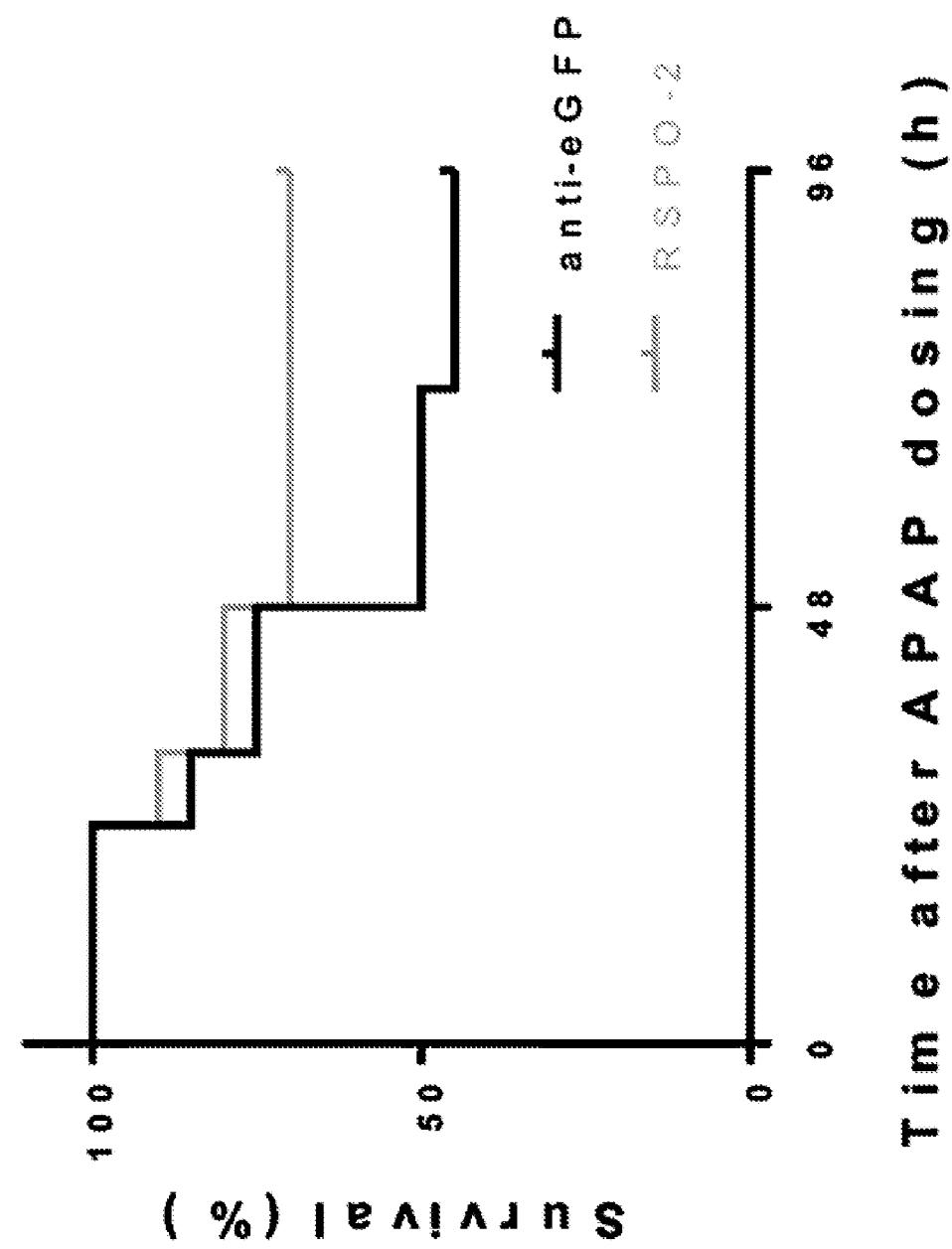
FIG. 46 (contd.)

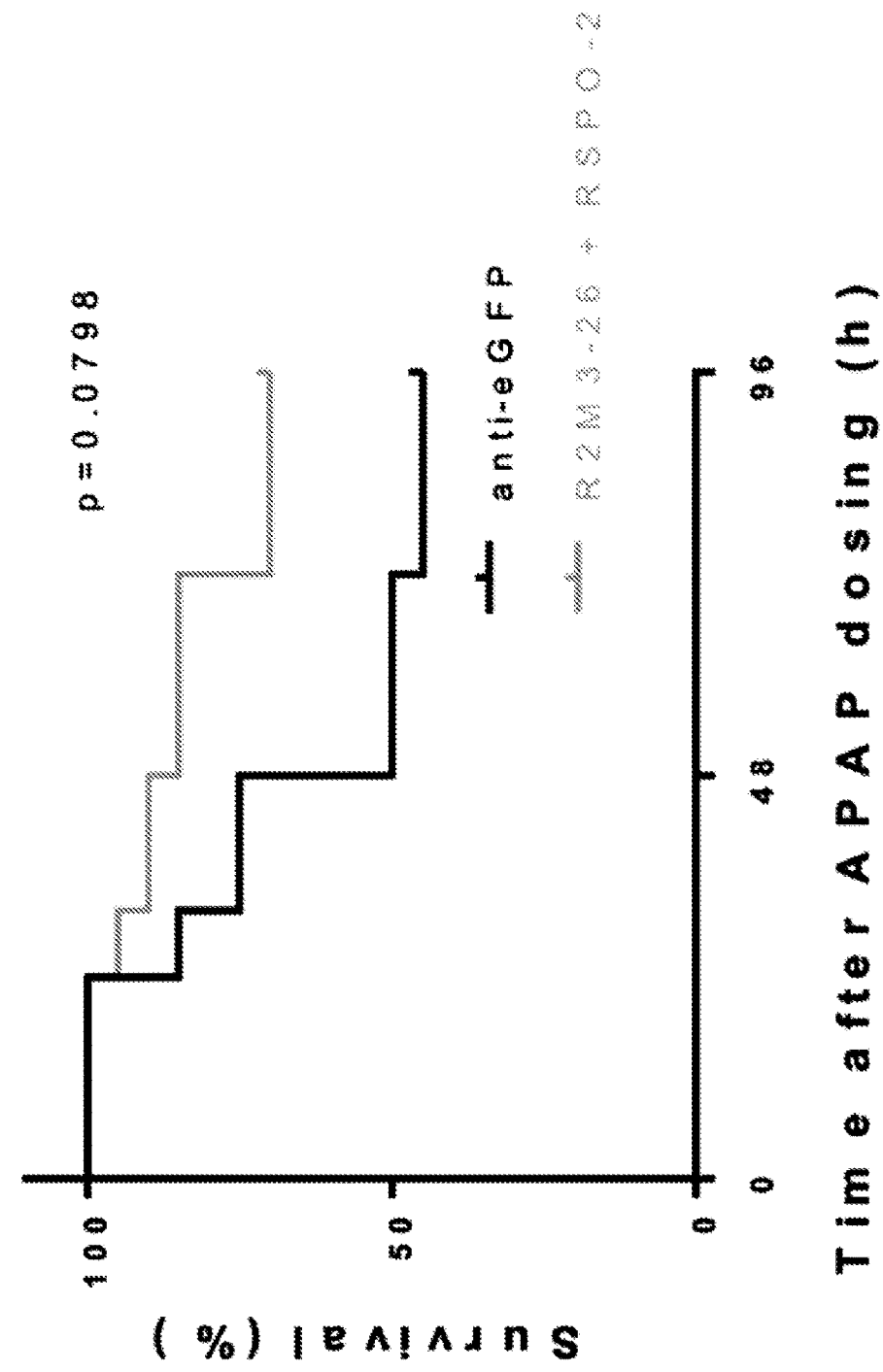
FIG. 46 (contd.)

WNT SURROGATE MOLECULES AND USES THEREOF

CROSS REFERENCE TO RELATED APPLICATIONS

This application is a National Stage Application under 35 U.S.C. § 371 of International Application No. PCT/US2018/066616, filed Dec. 19, 2018, which claims the benefit under 35 U.S.C. § 119(e) of U.S. Provisional Application No. 62/607,875, filed Dec. 19, 2017, U.S. Provisional Application No. 62/641,217, filed Mar. 9, 2018, and U.S. Provisional Application No. 62/680,522, filed Jun. 4, 2018, each of which is incorporated by reference herein in its entirety.

STATEMENT REGARDING SEQUENCE LISTING

The Sequence Listing associated with this application is provided in text format in lieu of a paper copy, and is hereby incorporated by reference into the specification. The name of the text file containing the Sequence Listing is SRZN_006_03WO_ST25.txt. The text file is 1.2 MB, was created on Dec. 19, 2018, and is being submitted electronically via EFS-Web.

BACKGROUND

Technical Field

The present invention relates generally to Wnt signaling pathway agonist molecules, compositions, and methods of using the same. Such molecules are useful, for example, in modulating Wnt signaling pathways.

Description of the Related Art

Wnt ("Wingless-related integration site" or "Wingless and Int-1" or "Wingless-Int") ligands and their signals play key roles in the control of development, homeostasis and regeneration of many essential organs and tissues, including bone, liver, skin, stomach, intestine, kidney, central nervous system, mammary gland, taste bud, ovary, cochlea and many other tissues (reviewed, e.g., by Clevers, Loh, and Nusse, 2014; 346:1248012). Modulation of Wnt signaling pathways has potential for treatment of degenerative diseases and tissue injuries.

One of the challenges for modulating Wnt signaling as a therapeutic is the existence of multiple Wnt ligands and Wnt receptors, Frizzled 1-10 (Fzd1-10), with many tissues expressing multiple and overlapping Fzds. Canonical Wnt signals also involve Low-density lipoprotein (LDL) receptor-related protein 5 (LRP5) or Low-density lipoprotein (LDL) receptor-related protein 6 (LRP6) as co-receptors, which are broadly expressed in various tissues, in addition to Fzds. Accordingly, there is clearly a need in the art for binding moieties that specifically bind to one or more Fzd, LRP5, or LRP6 to modulate Wnt signaling pathways. The present invention addresses this need.

BRIEF SUMMARY

In various embodiments, the present invention provides WNT surrogate molecules and related uses thereof.

In one embodiment, the disclosure provides a soluble, bivalent, bispecific Wnt surrogate molecule, wherein the Wnt surrogate molecule comprises: (i) one or more regions that specifically binds to one or more Frizzled (Fzd) receptor (a Fzd binding region); and (ii) one or more regions that specifically binds to a Low-density lipoprotein (LDL) receptor-related protein 5 (LRP5) and/or a Low-density lipoprotein (LDL) receptor-related protein 6 (LRP6) (a LRP5/6 binding region).

In particular embodiments, the Wnt surrogate molecule comprises two or more Fzd binding regions and two or more LRP5/6 binding regions. In particular embodiments, one or more Fzd binding regions comprise one or more antigen-binding fragments of an antibody. In particular embodiments, one or more antigen-binding fragments are selected from the group consisting of: IgG, scFv, Fab, and VHH or sdAb In particular embodiments, any of the Fzd antigen-binding fragments comprise: (i) CDRH1, CDRH2 and CDRH3 sequences set forth for any of the antibodies of Tables 1A or 1B; and/or (ii) CDRL1, CDRL2 and CDRL3 sequences set forth for any of the antibodies of Tables 1A or 1B, or a variant of said Fzd binding region comprising one or more amino acid modifications, wherein said variant comprises less than 8 amino acid substitutions in said CDR sequences. In particular embodiments, any of the Fzd binding regions comprise an amino acid sequence having at least 90% identity to any of the sequences set forth in SEQ ID NOs:1-65 or 129-132, or an antigen-binding fragment thereof.

In particular embodiments, any of the Fzd binding regions bind to one or more of Frizzled 1 (Fzd1), Frizzled 2 (Fzd2), Frizzled 3 (Fzd3), Frizzled 4 (Fzd4), Frizzled 5 (Fzd5), Frizzled 6 (Fzd6), Frizzled 7 (Fzd7), Frizzle 8 (Fzd8), Frizzled 9 (Fzd9), and Frizzled 10 (Fzd10). In particular embodiments, any of the Fzd binding region binds to two or more of Frizzled 1 (Fzd1), Frizzled 2 (Fzd2), Frizzled 3 (Fzd3), Frizzled 4 (Fzd4), Frizzled 5 (Fzd5), Frizzled 6 (Fzd6), Frizzled 7 (Fzd7), Frizzled 8 (Fzd8), Frizzled 9 (Fzd9), and Frizzled 10 (Fzd10). In particular embodiments, any of the Fzd binding region binds to: (i) Fzd1, Fzd2, Fzd7 and Fzd9; (ii) Fzd1, Fzd2 and Fzd7; (iii) Fzd5 and Fzd8; (iv) Fzd5, Fzd7 and Fzd8; (v) Fzd1, Fzd4, Fzd5 and Fzd8; (vi) Fzd1, Fzd2, Fzd5, Fzd7 and Fzd8; (vii) Fzd4 and Fzd9; (viii) Fzd9 and Fzd10; (ix) Fzd5, Fzd8 and Fzd10; or (x) Fzd4, Fzd5 and Fzd8; Fzd1, Fzd5, Fzd7 and Fzd8.

In particular embodiments, any of the surrogate molecules comprise one or more LRP5/6 binding regions comprise one or more antigen-binding fragments of an antibody. In particular embodiments, the one or more antigen-binding fragments are selected from the group consisting of: IgG, scFv, Fab, and VHH or sdAb In particular embodiments, any of the one or more LRP5/6 binding regions or antigen-binding fragments comprise: (i) CDRH1, CDRH2 and CDRH3 sequences set forth for any of the antibodies of Table 2; and/or (ii) CDRL1, CDRL2 and CDRL3 sequences set forth for any of the antibodies of Table 2, or a variant of said LRP5/6 binding region comprising one or more amino acid modifications, wherein said variant comprises less than 8 amino acid substitutions in said CDR sequences. In particular embodiments, any of the one or more LRP5/6 binding regions comprise an amino acid sequence having at least 90% identity to any of the sequences set forth in SEQ ID NOs:66-88 or 133, or an antigen-binding fragment thereof.

In particular embodiments of any of the Wnt surrogate molecules, the Fzd binding region comprising a Fab, and the LRP5/6 binding region comprising a VHH or sdAb In particular embodiments, the Fab is present within a full immunoglobulin (Ig), optionally an IgG, comprising a light chain and a heavy chain. In particular embodiments, the LRP5/6 binding region is fused to the N-terminus or the C-terminus of the heavy chain. In particular embodiments, the LRP5/6 binding region is fused to the N-terminus or the C-terminus of the light chain. In certain embodiments, the LRP5/6 binding region is fused to the N-terminus of the heavy chain of the full Ig or the N-terminus of the light chain of the full Ig. In certain embodiments, the LRP5/6 binding region is fused to the C-terminus of the heavy chain of the full Ig or the C-terminus of the light chain of the full Ig. In certain embodiments, the variable light chain region of the LRP5/6 binding Fab is fused to the N-terminus of the variable heavy chain region of the full Ig. In certain embodiments, the variable light chain region of the LRP5/6 binding Fab is fused to the N-terminus of the variable heavy chain region of the full Ig, and the variable heavy chain region of the LRP5/6 binding Fab is fused to the N-terminus of the variable light chain region of the full IgG. In particular embodiments, any of the LRP5/6 binding region is fused to the heavy chain or the light chain via one or more linker moiety.

In certain embodiments of any of the Wnt surrogate molecules, the Fzd binding region comprises a VHH or sdAb and the LRP5/6 binding region comprises a Fab. In particular embodiments, the Fab is present within a full immunoglobulin (Ig), optionally an IgG, comprising a light chain and a heavy chain. In certain embodiments, the Fzd binding region is fused to the N-terminus or the C-terminus of the heavy chain. In certain embodiments, the Fzd binding region is fused to the N-terminus or the C-terminus of the light chain. In some embodiment, the Fzd binding region is fused to the N-terminus of the heavy chain of the full Ig or the N-terminus of the light chain of the full Ig. In some embodiments, the Fzd binding region is fused to the C-terminus of the heavy chain of the full Ig or the C-terminus of the light chain of the full Ig. In some embodiments, the variable light chain region of the Fzd binding Fab is fused to the N-terminus of the variable heavy chain region of the full Ig. In some embodiments, the variable light chain region of the Fzd binding Fab is fused to the N-terminus of the variable heavy chain region of the full Ig, and the variable heavy chain region of the Fzd binding Fab is fused to the N-terminus of the variable light chain region of the full IgG. In certain embodiments, any of the Fzd binding region is fused to the heavy chain or the light chain via one or more linker moiety.

In another embodiment, any of the Fzd binding region comprises a Fab or Fv, and the LRP5/6 binding region comprises a Fab or Fv. In particular embodiments, the Fab of the Fzd binding region or the Fab or Fv of the LRP5/6 binding region is present within a full immunoglobulin (Ig), optionally an IgG, comprising a light chain and a heavy chain. In particular embodiments, only one of the Fab of the Fzd binding region or the Fab of the LRPp5/6 binding region is present within the full immunoglobulin (Ig). In particular embodiments, the Fab or Fv of the Fzd binding region is present within the full Ig. In particular embodiments, the Fab or Fv of the LRP5/6 binding region is fused to the N-terminus of the Ig. In particular embodiments, the Fab of the LRP5/6 binding region is fused to the C-terminus of the Ig. In a further embodiment, the Fab of the LRP5/6 binding region is present within the full Ig. In particular embodiments, the Fab of the Fzd binding region is fused to the N-terminus of the Ig. In particular embodiments, the Fab of the Fzd binding region is fused to the C-terminus of the Ig. In some embodiments, the variable light chain region of the Fzd binding Fab is fused to the N-terminus of the variable heavy chain region of the full Ig, and the variable heavy chain region of the Fzd binding Fab is fused to the N-terminus of the variable light chain region of the full IgG. In some embodiments, the variable light chain region of the LRP5/6 binding Fv is fused to the N-terminus of the variable heavy chain region of the full Ig, and the variable heavy chain region of the LRP5/6 binding Fv is fused to the N-terminus of the variable light chain region of the full IgG. In some embodiments, the variable heavy chain region of the LRP5/6 binding Fv is fused to the N-terminus of the variable heavy chain region of the full Ig, and the variable light chain region of the LRP5/6 binding Fv is fused to the N-terminus of the variable light chain region of the full IgG. In some embodiments, variable light chain region of the Fzd binding Fv is fused to the N-terminus of the variable heavy chain region of the full Ig, and the variable heavy chain region of the Fzd binding Fv is fused to the N-terminus of the variable light chain region of the full IgG. In some embodiments, the variable heavy chain region of the Fzd binding Fv is fused to the N-terminus of the variable heavy chain region of the full Ig, and the variable light chain region of the Fzd binding Fv is fused to the N-terminus of the variable light chain region of the full IgG.

In another embodiment, any of the Fzd binding regions comprises a VHH or sdAb, and the LRP5/6 binding region comprises a VHH or sdAb. In particular embodiments, the Fzd binding region is fused to the Lrp5/6 binding region, and wherein the Fzd binding region or the LRP5/6 binding region is fused to an Fc region. In particular embodiments, the Fzd binding region is fused to the N-terminus of an Fc region, and wherein the LRP5/6 binding region is fused to the C-terminus of an Fc region. In particular embodiments, the Fzd binding region is fused to the C-terminus of an Fc region, and wherein the LRP5/6 binding region is fused to the N-terminus of an Fc region.

In a further embodiment, any of the antibodies or one or more antigen-binding fragment thereof, is humanized. In a further embodiment, any of the Wnt surrogate molecules binds to one or more Fzd receptor with a $K_D$ of 50 μM or lower. In further embodiments, any of the Wnt surrogate molecules binds to LRP5 and/or LRP6 with a $K_D$ of 50 μM or lower.

In a further embodiment, any of the Wnt surrogate molecule modulates a Wnt signaling pathway in a cell, optionally a mammalian cell. In particular embodiments, the Wnt surrogate molecule increases signaling via the Wnt signaling pathway in the cell. In particular embodiments, the Wnt signaling pathway is a canonical Wnt signaling pathway or a non-canonical Wnt signaling pathway.

In a related embodiment, the present disclosure provides an isolated polynucleotide encoding a polypeptide sequence comprising one or more of the Fzd binding regions and/or one or more of the LRP5/6 binding regions of a Wnt surrogate molecule. In particular embodiments, the present disclosure provides an expression vector comprising the isolated polynucleotide. In further particular embodiments, the present disclosure provides an isolated host cell comprising the expression vector.

In a related embodiment, the present disclosure provides a pharmaceutical composition comprising a physiologically acceptable excipient, diluent, or carrier, and a therapeutically effective amount of any of the Wnt surrogate molecules disclosed herein.

In related embodiments, the present disclosure provides a method for agonizing a Wnt signaling pathway in a cell, comprising contacting the cell any of the Wnt surrogate molecules, wherein the Wnt surrogate molecule is an agonist of a Wnt signaling pathway.

In particular embodiments, the present disclosure provides a method for treating a subject having a disease or disorder associated with reduced Wnt signaling, comprising administering to the subject an effective amount of the pharmaceutical composition, wherein the Wnt surrogate molecule is an agonist of a Wnt signaling pathway. In particular embodiments, the disease or disorder is selected from the group consisting of: bone fractures, osteoporosis (e.g., post-menopausal osteoporosis), osteoporotic fractures, spinal fusion, vertebral compression fracture, pre-operative spinal surgery optimization, osseointegration of orthopedic devices, tendon-bone integration, tooth growth and regeneration, dental implantation, periodontal diseases, maxillofacial reconstruction, osteonecrosis of the jaw, osteoarthritis (OA), muscular dystrophy, muscle atrophy resulting from sarcopenia or cachexia, alopecia, hearing loss, including regeneration of inner and outer auditory hair cells, vestibular hypofunction, macular degeneration, vitreoretinopathy, diseases of retinal degeneration, including diabetic retinopathy, diseases/disorders affecting the integrity of the blood brain barrier, Fuchs' dystrophy, stroke, traumatic brain injury, Alzheimer's disease, multiple sclerosis, spinal cord injuries, oral mucositis, short bowel syndrome, inflammatory bowel diseases (IBD), including Crohn's disease (CD) and ulcerative colitis (UC), in particular IBD with fistula formation, metabolic syndrome, diabetes, dyslipidemia, pancreatitis, exocrine pancreatic insufficiency, wound healing, diabetic foot ulcers, coronary artery disease, acute kidney injuries, chronic kidney diseases, chronic obstructive pulmonary diseases (COPD), pulmonary fibrosis, including idiopathic pulmonary fibrosis, acute liver failure, acute alcoholic liver injuries, chronic liver diseases with hepatitis C virus (HCV), HCV subjects post-antiviral drug therapies, chronic liver diseases with hepatitis B virus (HBV), fibrosis, HBV subjects post-antiviral drug therapies, chronic alcoholic liver diseases, alcoholic hepatitis, non-alcoholic fatty liver diseases and non-alcoholic steatohepatitis (NASH), cirrhosis, and chronic liver insufficiencies of all causes. In certain embodiments, the disease or disorder is a bone disease or disorder. In particular embodiments, the disease or disorder is a bone disease or disorder, and the Wnt surrogate molecule binds Fzd1, Fzd2, and FZD7, and binds LRP5 and/or LRP6. In certain embodiments, the disease or disorder is a bone disease or disorder, and the Wnt surrogate molecule binds Fzd1, Fzd2, FZD7, Fzd5 and Fzd8, and also binds LRP5 and/or LRP6.

In another related embodiment, the present disclosure provides a method for increasing bone mineral density, increasing bone volume, increasing bone cortical thickness, increasing bone mineral apposition rate, increasing bone stiffness, increasing bone biomechanical strength, increasing resistance to bone fracture, decreasing bone resorption, or decreasing bone loss associated with osteoporosis, in a subject in need thereof, comprising providing to the subject an effective amount of a pharmaceutical composition comprising a Wnt surrogate molecule, wherein the Wnt surrogate molecule is an agonist of a Wnt signaling pathway. In certain embodiments, the Wnt surrogate molecule binds Fzd1, Fzd2, and FZD7, and binds LRP5 and/or LRP6. In certain embodiments, the Wnt surrogate molecule binds Fzd1, Fzd2, FZD7, Fzd5 and Fzd8, and also binds LRP5 and/or LRP6.

In particular embodiments, methods of the invention, including those related to treating or preventing a bone disease or disorder, such as osteoporosis (e.g., post-menopausal osteoporosis), further comprise providing the subject an antiresorptive agent (in combination with a Wnt surrogate molecule). Examples of anti-resorptive agents include, but are not limited to, bisphosphonates or selective estrogen receptor modulators. Antiresorptive agents are used to increase bone strength in individuals with osteoporosis and include five principal classes of agents: bisphosphonates, estrogens, selective estrogen receptor modulators (SERMs), calcitonin and monoclonal antibodies such as denosumab, any of which may be used. Illustrative examples of antiresorptive agents include, but are not limited to: bisphosphonates, e.g., alendronate-generic medication (Brand name: Fosamax™, Fosamax™ Plus D), risedronate (Brand name: Actonel™, Actonel™ with Calcium), ibandronate (Brand name: Boniva™), and zoledronic acid (Brand name: Reclast™); other antiresorptives, e.g., estrogen therapy or hormone therapy, raloxifene (Brand name: Evista™), and denosumab (Prolial™); and anabolic medication, e.g., teriparatide (Forteo™).

In a further related embodiment, the present disclosure provides a method for increasing liver to body weight ratio, promoting liver regeneration, increasing liver cell proliferation or mitosis, decreasing liver fibrosis, optionally following a chronic liver injury, increasing hepatocyte function, or decreasing coagulation time in liver, in a subject in need thereof, comprising providing to the subject an effective amount of a pharmaceutical composition comprising a Wnt surrogate molecule, wherein the Wnt surrogate molecule is an agonist of a Wnt signaling pathway.

BRIEF DESCRIPTION OF THE DRAWINGS

FIGS. 2A-2D. Characterization of a Wnt surrogate molecule, R2M3-26.

FIGS. 4A-4B. Graphs showing that R2M3-26 and R2M3-32 activities can be inhibited by soluble Fzd ECD and by R2M3 IgG alone without the Lrp binding arm.

FIG. 8A-8B. Characterization of illustrative Fzd binders-Lrp6 binder 26 fusions in 293 Wnt dependent reporter assays.

FIG. 15A-15G. Characterization of various Wnt Surrogate molecules in the Fab-IgG format in 293 Wnt dependent reporter assays.

FIG. 19. Sequences of polypeptide chains of illustrative Wnt surrogates molecules.

FIG. 20A-20B. In vivo PK/PD characterization of R2M3-26

FIGS. 21A-21E. Images and graphs showing that systemic expression of 18R5-DKK1c for 14 days results in increased bone mineral density. *P value<0.05; ** P value<0.0001. For each time point, the bars from left to right are as follows: vehicle (diamond), romosozumab (square), AAV CAG-GFP (triangle), AAV ScFv (anti-GFP)-DKK1cF234K-Flag-His (inverted triangle), and AAV 18R5-DKK1c-FLagHis (circle).

FIGS. 24A-24D. Graphs and images showing that systemic expression of 18R5-DKK1c results in increased osteoblast and reduced osteoclast on bone surface. For each time point, the bars from left to right are as follows: vehicle, romosozumab, AAV CAG-GFP, AAV ScFv (anti-GFP)-DKK1cF234K-Flag-His, and AAV 18R5-DKK1c-FlagHis. ** P value<0.05.

FIGS. 26A-26D. Graphs and images showing that systemic treatment with R2M3-26 results in rapid and sustained increase in bone after one week. For each timepoint, the bars from left to right correspond to the treatments indicated from top to bottom. **** indicates P value<0.0001.

FIGS. 33A-D. Test of Wnt surrogate molecules in an Einhorn fracture model. Radiographs of the callus after 1 week (A) and 6 weeks (B) of treatment with Wnt surrogate molecules are shown. Graphs of changes in whole body bone mineral density (BMD) in contralateral femur are shown (C). Scatter plots showing changes in callus tissue volume, callus bone volume, bone volume/tissue volume ratio (BV/TV), and bone mineral content per millimeter (BMC/mm) as shown in (D) along with representative images of bone slices are shown.

FIGS. 40A-40H. Efficacy of AAV-delivered Wnt surrogate and R-Spondin in a thioacetamide-induced chronic liver disease model. Design for study 1 (A) and study 2 (B). Liver to body weight ratio (C-D), liver weight (E-F), liver collagen A1 mRNA expression (G) and percentage red area in liver histological sections stained with Sirius red (H) in response to AAV-delivered wnt surrogate and R-spondin in study 1 (C, E, G and H) and study 2 (D, F, H). (*) p<0.05, () p<0.01, (*) p<0.001, (****) p<0.0001. For each graph, the treatments shown from left to right correspond to those in the legend from top to bottom (not including baseline).

FIGS. 41A-41N. Efficacy of recombinantly produced Wnt surrogate and R-Spondin in a thioacetamide-induced chronic liver disease model. Study design (A). D-2, D0, D3, D7, D10, D14 represents days relative to the start of treatment with recombinant proteins. Liver to body weight ratio (B, C), liver axin2 mRNA (D, E), cyclinD1 mRNA (F, G) and Ki67 mRNA (H, I) expression, average count of PCNA (J, K) or phospho-histone H3 (L, M) positive nuclei per 10× field after immunohistochemistry staining with PCNA and phospho-histone H3 antibodies respectively, in a study using Rspo2 mono treatment (B, D, F, H, J, L) or R2M3-26/Rspo2 combination treatment (C, E, G, I, K, M). Pro-thrombin time ratio relative to the average pro-thrombin time in plasma collected from control naïve mice without TAA exposure (N). (*) $p<0.05$, () $p<0.01$, (**) $p<0.0001$. No TAA treatment is indicated by the dashed line. For each bar graph timepoint, the treatments shown from left to right correspond to those in the legend shown above from top to bottom.

Figure 42:
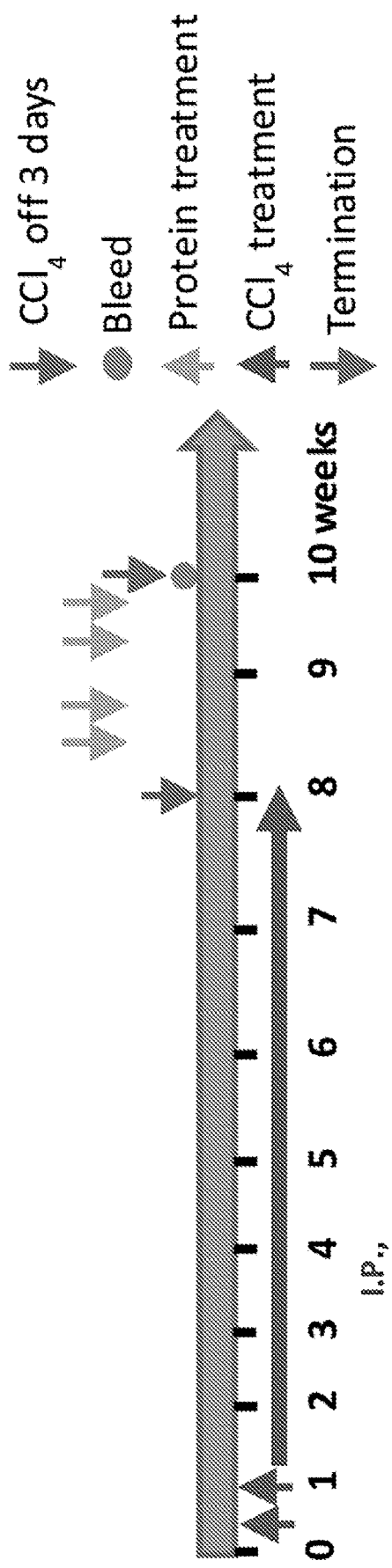

FIGS. 42A-42C. Efficacy of recombinantly produced Wnt surrogate and R-Spondin in a CC14-induced chronic liver disease model. Study design (A). Liver to body weight ratio (B) pro-thrombin time (C) and sirius red staining (D) in response to CC14 treatment, R2M3-26 and Rspo2. (*) $p<0.05$, () $p<0.01$, (*) $p<0.001$, (****) $p<0.0001$. For each graph, the treatments shown from left to right correspond to those in the legend from top to bottom (not including baseline).

FIGS. 43A-43D. Induction of proliferation markers in response to recombinantly produced Wnt surrogate in an acetaminophen-induced acute liver injury model. Study design (A). Serum level of alanine transferase at 24 and 48 hours after treatment with acetaminophen (B). Relative cyclinD1 (C) and Ki67 (D) mRNA expression. (*) $p<0.05$, (*) $p<0.001$, (**) $p<0.0001$.

FIGS. 44A-44D. Induction of proliferation markers in response to R-Spondin in an acetaminophen-induced acute liver injury model. Study design (A). Serum level of alanine transferase at 24 and 48 hours after treatment with acetaminophen (B). Relative cyclinD1 (C) and Ki67 (D) mRNA expression. () $p<0.01$, (*) $p<0.001$, (****) $p<0.0001$.

FIGS. 45A-45D. Induction of proliferation markers in response to Wnt surrogate and R-Spondin in an acetaminophen-induced acute liver injury model. Study design (A). Serum level of alanine transferase at 24, 36, 48 and 60 hours after treatment with acetaminophen (B). Relative cyclinD1 (C) and Ki67 (D) mRNA expression. (*) $p<0.05$, (****) $p<0.0001$. For each time point, the treatments shown from left to right correspond to those in the legend from top to bottom.

FIGS. 46A-46D. Efficacy of recombinantly produced Wnt surrogate and R-Spondin on the survival of mice after acetaminophen-induced liver injury. Study design (A). Survival curve of mice treated with the control anti-eGFP control protein or R2M3-26 (B), Rspo2 (C) or a combination of R2M3-26 and Rspo2 (D) recombinant proteins.

DETAILED DESCRIPTION

The present disclosure relates to Wnt surrogate molecules that bind to one or more Fzd receptor and one or more LRP5 or LRP6 receptor and modulate a downstream Wnt signaling pathway. In particular embodiments, the Wnt surrogate molecules activate a Wnt signaling pathway or increase signaling via a Wnt signaling pathway. In particular embodiments, the Wnt surrogate molecules disclosed herein comprise: (i) one or more antibodies or antigen-binding fragments thereof that specifically bind to one or more Fzd receptor, including antibodies or antigen-binding fragments thereof having particular Fzd receptor specificity and/or functional properties; and (ii) one or more antibodies or antigen-binding fragments thereof that specifically bind to LRP5 and/or LRP6. Certain embodiments encompass specific structural formats or arrangements of the Fzd binding region(s) and LRP5/6 binding region(s) of Wnt surrogate molecules advantageous in increasing downstream Wnt pathway signaling and related biological effects.

Embodiments of the invention pertain to the use of Wnt surrogate molecules for the diagnosis, assessment and treatment of diseases and disorders associated with Wnt signaling pathways. In certain embodiments, the subject Wnt surrogate molecules are used to modulate a Wnt signaling pathway in a cell or tissue. In certain embodiments, the subject Wnt surrogate molecules are used in the treatment or prevention of diseases and disorders associated with aberrant or deregulated (e.g., reduced) Wnt signaling, or for which modulating, e.g., increasing, Wnt signaling would provide a therapeutic benefit.

The practice of the present invention will employ, unless indicated specifically to the contrary, conventional methods of virology, immunology, microbiology, molecular biology and recombinant DNA techniques within the skill of the art, many of which are described below for the purpose of illustration. Such techniques are explained fully in the literature. See, e.g., *Current Protocols in Molecular Biology* or *Current Protocols in Immunology*, John Wiley & Sons, New York, N.Y. (2009); Ausubel et al., *Short Protocols in Molecular Biology*, 3rd ed., Wiley & Sons, 1995; Sambrook and Russell, *Molecular Cloning: A Laboratory Manual* (3rd Edition, 2001); Maniatis et al. *Molecular Cloning: A Laboratory Manual* (1982); *DNA Cloning: A Practical Approach*, vol. I & II (D. Glover, ed.); *Oligonucleotide Synthesis* (N. Gait, ed., 1984); *Nucleic Acid Hybridization* (B. Hames & S. Higgins, eds., 1985); *Transcription and Translation* (B. Hames & S. Higgins, eds., 1984); *Animal Cell Culture* (R. Freshney, ed., 1986); Perbal, *A Practical Guide to Molecular Cloning* (1984) and other like references.

As used in this specification and the appended claims, the singular forms "a," "an" and "the" include plural references unless the content clearly dictates otherwise.

Throughout this specification, unless the context requires otherwise, the word "comprise", or variations such as "comprises" or "comprising", will be understood to imply the inclusion of a stated element or integer or group of elements or integers but not the exclusion of any other element or integer or group of elements or integers.

Each embodiment in this specification is to be applied mutatis mutandis to every other embodiment unless expressly stated otherwise.

Standard techniques may be used for recombinant DNA, oligonucleotide synthesis, and tissue culture and transformation (e.g., electroporation, lipofection). Enzymatic reactions and purification techniques may be performed according to manufacturer's specifications or as commonly accomplished in the art or as described herein. These and related techniques and procedures may be generally performed according to conventional methods well known in the art and as described in various general and more specific references that are cited and discussed throughout the present specification. Unless specific definitions are provided, the nomenclature utilized in connection with, and the laboratory procedures and techniques of, molecular biology, analytical chemistry, synthetic organic chemistry, and medicinal and pharmaceutical chemistry described herein are those well-known and commonly used in the art. Standard techniques may be used for recombinant technology, molecular biological, microbiological, chemical syntheses, chemical analyses, pharmaceutical preparation, formulation, and delivery, and treatment of subjects.

Embodiments of the present invention relate to antibodies and antigen-binding fragments thereof that bind to one or more Fzd receptor. Sequences of illustrative antibodies, or antigen-binding fragments, or complementarity determining regions (CDRs) thereof, are set forth in SEQ ID NOs:1-65 or 129-132, Tables 1A and 1B, and Table 3. Anti-Fzd antibodies and antigen-binding fragments there that may be used or present in the Wnt surrogate molecules disclosed herein include, but are not limited to, those described in the U.S. provisional application No. 62/607,877, titled Anti-Frizzled Antibodies and Methods of Use, filed on Dec. 19, 2017.

Embodiments of the present invention relate to antibodies and antigen-binding fragments thereof that bind to LRP5 and/or LRP6. Sequences of illustrative antibodies, or antigen-binding fragments, or complementarity determining regions (CDRs) thereof, are set forth in SEQ ID NOs:66-88 or 133, Tables 2A and 2B, and Table 3. Anti-LRP5/6 antibodies and antigen-binding fragments there that may be used or present in the Wnt surrogate molecules disclosed herein include, but are not limited to, those described in the U.S. provisional application No. 62/607,879, titled Anti-LRP5/6 Antibodies and Methods of Use, filed on Dec. 19, 2017.

As is well known in the art, an antibody is an immunoglobulin molecule capable of specific binding to a target, such as a carbohydrate, polynucleotide, lipid, polypeptide, etc., through at least one epitope recognition site, located in the variable region of the immunoglobulin molecule. As used herein, the term encompasses not only intact polyclonal or monoclonal antibodies, but also fragments thereof (such as dAb, Fab, Fab', F(ab')2, Fv), single chain (scFv), VHH or sdAb, synthetic variants thereof, naturally occurring variants, fusion proteins comprising an antibody or an antigen-binding fragment thereof, humanized antibodies, chimeric antibodies, and any other modified configuration of the immunoglobulin molecule that comprises an antigen-binding site or fragment (epitope recognition site) of the required specificity. "Diabodies" or 2scFV-Ig antibodies, are multivalent or multispecific fragments constructed by gene fusion (WO94/13804; P. Holliger et al., Proc. Natl. Acad. Sci. USA 90 6444-6448, 1993) are also a particular form of antibody contemplated herein. Minibodies comprising a scFv joined to a CH3 domain are also included herein (S. Hu et al., Cancer Res., 56, 3055-3061, 1996). See e.g., Ward, E. S. et al., Nature 341, 544-546 (1989); Bird et al., Science, 242, 423-426, 1988; Huston et al., PNAS USA, 85, 5879-5883, 1988); PCT/US92/09965; WO94/13804; P. Holliger et al., Proc. Natl. Acad. Sci. USA 90 6444-6448, 1993; Y. Reiter et al., Nature Biotech, 14, 1239-1245, 1996; S. Hu et al., Cancer Res., 56, 3055-3061, 1996.

The term "antigen-binding fragment" as used herein refers to a polypeptide fragment that contains at least one CDR of an immunoglobulin heavy and/or light chain, or of a VHH or sdAb, that binds to the antigen of interest, in particular to one or more Fzd receptor or LRP5 or LRP6 receptor. In this regard, an antigen-binding fragment of the herein described antibodies may comprise 1, 2, 3, 4, 5, or all 6 CDRs of a VH and VL sequence set forth herein from antibodies that bind one or more Fzd receptor or LRP5 and/or LRP6. In particular embodiments, an antigen-binding fragment may comprise all three VH CDRs or all three VL CDRs. Similarly, an antigen binding fragment thereof may comprise all three CDRs of a VHH or sdAb. An antigen-binding fragment of a Fzd-specific antibody is capable of binding to a Fzd receptor. An antigen-binding fragment of a LRP5/6-specific antibody is capable of binding to a LRP5 and/or LRP6 receptor. As used herein, the term encompasses not only isolated fragments but also polypeptides comprising an antigen-binding fragment of an antibody disclosed herein, such as, for example, fusion proteins comprising an antigen-binding fragment of an antibody disclosed herein, such as, e.g., a fusion protein comprising a VHH or sdAb that binds one or more Fzd receptors and a VHH or sdAb that binds LRP5 and/or LRP6.

The term "antigen" refers to a molecule or a portion of a molecule capable of being bound by a selective binding agent, such as an antibody, and additionally capable of being used in an animal to produce antibodies capable of binding to an epitope of that antigen. In certain embodiments, a binding agent (e.g., a Wnt surrogate molecule or binding region thereof) is said to specifically bind an antigen when it preferentially recognizes its target antigen in a complex mixture of proteins and/or macromolecules. In certain embodiments, a Wnt surrogate molecule or binding region thereof (e.g., an antibody or antigen-binding fragment thereof) is said to specifically bind an antigen when the equilibrium dissociation constant is $\leq 10^{-7}$ or $\leq 10^{-8}$ M. In some embodiments, the equilibrium dissociation constant may be $\leq 10^{-9}$ M or $\leq 10^{-10}$ M.

In certain embodiments, antibodies and antigen-binding fragments thereof as described herein include a heavy chain and a light chain CDR set, respectively interposed between a heavy chain and a light chain framework region (FR) set which provide support to the CDRs and define the spatial relationship of the CDRs relative to each other. As used herein, the term "CDR set" refers to the three hypervariable regions of a heavy or light chain V region. Proceeding from the N-terminus of a heavy or light chain, these regions are denoted as "CDR1," "CDR2," and "CDR3" respectively. An antigen-binding site, therefore, includes six CDRs, comprising the CDR set from each of a heavy and a light chain V region. A polypeptide comprising a single CDR, (e.g., a CDR1, CDR2 or CDR3) is referred to herein as a "molecular recognition unit." Crystallographic analysis of a number of antigen-antibody complexes has demonstrated that the amino acid residues of CDRs form extensive contact with bound antigen, wherein the most extensive antigen contact is with the heavy chain CDR3. Thus, the molecular recognition units are primarily responsible for the specificity of an antigen-binding site.

As used herein, the term "FR set" refers to the four flanking amino acid sequences which frame the CDRs of a CDR set of a heavy or light chain V region. Some FR residues may contact bound antigen; however, FRs are primarily responsible for folding the V region into the antigen-binding site, particularly the FR residues directly adjacent to the CDRs. Within FRs, certain amino residues and certain structural features are very highly conserved. In this regard, all V region sequences contain an internal disulfide loop of around 90 amino acid residues. When the V regions fold into a binding-site, the CDRs are displayed as projecting loop motifs which form an antigen-binding surface. It is generally recognized that there are conserved structural regions of FRs which influence the folded shape of the CDR loops into certain "canonical" structures—regardless of the precise CDR amino acid sequence. Further, certain FR residues are known to participate in non-covalent interdomain contacts which stabilize the interaction of the antibody heavy and light chains.

The structures and locations of immunoglobulin CDRs and variable domains may be determined by reference to Kabat, E. A. et al., Sequences of Proteins of Immunological Interest. 4th Edition. US Department of Health and Human Services. 1987, and updates thereof, now available on the Internet (immuno.bme.nwu.edu). Alternatively, CDRs may be determined by using "IMGT®, the international ImMunoGeneTics information System® available at www.imgt.org (see, e.g., Lefranc, M.-P. et al. (1999) *Nucleic Acids Res.*, 27:209-212; Ruiz, M. et al. (2000) *Nucleic Acids Res.*, 28:219-221; Lefranc, M.-P. (2001) *Nucleic Acids Res.*, 29:207-209; Lefranc, M.-P. (2003) *Nucleic Acids Res.*, 31:307-310; Lefranc, M.-P. et al. (2004) *In Silico Biol.*, 5, 0006 [Epub], 5:45-60 (2005)]; Lefranc, M.-P. et al. (2005) *Nucleic Acids Res.*, 33:D593-597; Lefranc, M.-P. et al. (2009) *Nucleic Acids Res.*, 37:D1006-1012; Lefranc, M.-P. et al. (2015) *Nucleic Acids Res.*, 43:D413-422).

A "monoclonal antibody" refers to a homogeneous antibody population wherein the monoclonal antibody is comprised of amino acids (naturally occurring and non-naturally occurring) that are involved in the selective binding of an epitope. Monoclonal antibodies are highly specific, being directed against a single epitope. The term "monoclonal antibody" encompasses not only intact monoclonal antibodies and full-length monoclonal antibodies, but also fragments thereof (such as Fab, Fab', F(ab')2, Fv), single chain (scFv), VHH or sdAb, variants thereof, fusion proteins comprising an antigen-binding fragment of a monoclonal antibody, humanized monoclonal antibodies, chimeric monoclonal antibodies, and any other modified configuration of the immunoglobulin molecule that comprises an antigen-binding fragment (epitope recognition site) of the required specificity and the ability to bind to an epitope, including Wnt surrogate molecules disclosed herein. It is not intended to be limited as regards the source of the antibody or the manner in which it is made (e.g., by hybridoma, phage selection, recombinant expression, transgenic animals, etc.). The term includes whole immunoglobulins as well as the fragments etc. described above under the definition of "antibody".

The proteolytic enzyme papain preferentially cleaves IgG molecules to yield several fragments, two of which (the F(ab) fragments) each comprise a covalent heterodimer that includes an intact antigen-binding site. The enzyme pepsin is able to cleave IgG molecules to provide several fragments, including the F(ab')2 fragment which comprises both antigen-binding sites. An Fv fragment for use according to certain embodiments of the present invention can be produced by preferential proteolytic cleavage of an IgM, and on rare occasions of an IgG or IgA immunoglobulin molecule. Fv fragments are, however, more commonly derived using recombinant techniques known in the art. The Fv fragment includes a non-covalent $V_H$::$V_L$ heterodimer including an antigen-binding site which retains much of the antigen recognition and binding capabilities of the native antibody molecule. Inbar et al. (1972) *Proc. Nat. Acad. Sci. USA* 69:2659-2662; Hochman et al. (1976) *Biochem* 15:2706-2710; and Ehrlich et al. (1980) *Biochem* 19:4091-4096.

In certain embodiments, single chain Fv or scFV antibodies are contemplated. For example, Kappa bodies (III et al., *Prot. Eng.* 10: 949-57 (1997); minibodies (Martin et al., *EMBO J* 13: 5305-9 (1994); diabodies (Holliger et al., *PNAS* 90: 6444-8 (1993); or Janusins (Traunecker et al., *EMBO J* 10: 3655-59 (1991) and Traunecker et al., *Int. J. Cancer Suppl.* 7: 51-52 (1992), may be prepared using standard molecular biology techniques following the teachings of the present application with regard to selecting antibodies having the desired specificity. In still other embodiments, bispecific or chimeric antibodies may be made that encompass the ligands of the present disclosure. For example, a chimeric antibody may comprise CDRs and framework regions from different antibodies, while bispecific antibodies may be generated that bind specifically to one or more Fzd receptor through one binding domain and to a second molecule through a second binding domain. These antibodies may be produced through recombinant molecular biological techniques or may be physically conjugated together.

A single chain Fv (scFv) polypeptide is a covalently linked $V_H$::$V_L$ heterodimer which is expressed from a gene fusion including $V_H$- and $V_L$-encoding genes linked by a peptide-encoding linker. Huston et al. (1988) *Proc. Nat. Acad. Sci. USA* 85(16):5879-5883. A number of methods have been described to discern chemical structures for converting the naturally aggregated—but chemically separated—light and heavy polypeptide chains from an antibody V region into an scFv molecule which will fold into a three dimensional structure substantially similar to the structure of an antigen-binding site. See, e.g., U.S. Pat. Nos. 5,091,513 and 5,132,405, to Huston et al.; and U.S. Pat. No. 4,946,778, to Ladner et al.

In certain embodiments, an antibody as described herein is in the form of a diabody. Diabodies are multimers of polypeptides, each polypeptide comprising a first domain comprising a binding region of an immunoglobulin light chain and a second domain comprising a binding region of an immunoglobulin heavy chain, the two domains being linked (e.g. by a peptide linker) but unable to associate with each other to form an antigen binding site: antigen binding sites are formed by the association of the first domain of one polypeptide within the multimer with the second domain of another polypeptide within the multimer (WO94/13804).

A dAb fragment of an antibody consists of a $V_H$ domain (Ward, E. S. et al., Nature 341, 544-546 (1989)).

Where bispecific antibodies are to be used, these may be conventional bispecific antibodies, which can be manufactured in a variety of ways (Holliger, P. and Winter G. *Current Opinion Biotechnol.* 4, 446-449 (1993)), e.g. prepared chemically or from hybrid hybridomas, or may be any of the bispecific antibody fragments mentioned above. Diabodies and scFv can be constructed without an Fc region, using only variable domains, potentially reducing the effects of anti-idiotypic reaction.

Bispecific diabodies, as opposed to bispecific whole antibodies, may also be particularly useful because they can be readily constructed and expressed in *E. coli*. Diabodies (and many other polypeptides such as antibody fragments) of appropriate binding specificities can be readily selected using phage display (WO94/13804) from libraries. If one arm of the diabody is to be kept constant, for instance, with a specificity directed against antigen X, then a library can be made where the other arm is varied and an antibody of appropriate specificity selected. Bispecific whole antibodies may be made by knobs-into-holes engineering (J. B. B. Ridgeway et al., *Protein Eng.*, 9, 616-621, 1996).

In certain embodiments, the antibodies described herein may be provided in the form of a UniBody®. A UniBody® is an IgG4 antibody with the hinge region removed (see GenMab Utrecht, The Netherlands; see also, e.g., US20090226421). This proprietary antibody technology creates a stable, smaller antibody format with an anticipated longer therapeutic window than current small antibody formats. IgG4 antibodies are considered inert and thus do not interact with the immune system. Fully human IgG4 antibodies may be modified by eliminating the hinge region of the antibody to obtain half-molecule fragments having distinct stability properties relative to the corresponding intact IgG4 (GenMab, Utrecht). Halving the IgG4 molecule leaves only one area on the UniBody® that can bind to cognate antigens (e.g., disease targets) and the UniBody® therefore binds univalently to only one site on target cells.

In certain embodiments, the antibodies of the present disclosure may take the form of a VHH or sdAb. VHH or sdAb technology was originally developed following the discovery and identification that camelidae (e.g., camels and llamas) possess fully functional antibodies that consist of heavy chains only and therefore lack light chains. These heavy-chain only antibodies contain a single variable domain ($V_{HH}$) and two constant domains ($C_H2$, $C_H3$). The cloned and isolated single variable domains have full antigen binding capacity and are very stable. These single variable domains, with their unique structural and functional properties, form the basis of "VHH or sdAb". VHH or sdAb are encoded by single genes and are efficiently produced in almost all prokaryotic and eukaryotic hosts e.g. *E. coli* (see e.g. U.S. Pat. No. 6,765,087), molds (for example *Aspergillus* or *Trichoderma*) and yeast (for example *Saccharomyces, Kluyvermyces, Hansenula* or *Pichia* (see e.g. U.S. Pat. No. 6,838,254). The production process is scalable and multi-kilogram quantities of VHH or sdAb have been produced. VHH or sdAb may be formulated as a ready-to-use solution having a long shelf life. The VHH or sdAb method (see, e.g., WO 06/079372) is a proprietary method for generating VHH or sdAb against a desired target, based on automated high-throughput selection of B-cells. VHH or sdAb are single-domain antigen-binding fragments of camelid-specific heavy-chain only antibodies. VHH antibodies or sdAb, typically have a small size of around 15 kDa.

In certain embodiments, the antibodies or antigen-binding fragments thereof as disclosed herein are humanized. This refers to a chimeric molecule, generally prepared using recombinant techniques, having an antigen-binding site derived from an immunoglobulin from a non-human species and the remaining immunoglobulin structure of the molecule based upon the structure and/or sequence of a human immunoglobulin. The antigen-binding site may comprise either complete variable domains fused onto constant domains or only the CDRs grafted onto appropriate framework regions in the variable domains. Epitope binding sites may be wild type or modified by one or more amino acid substitutions. This eliminates the constant region as an immunogen in human individuals, but the possibility of an immune response to the foreign variable region remains (LoBuglio, A. F. et al., (1989) *Proc Natl Acad Sci USA* 86:4220-4224; Queen et al., *PNAS* (1988) 86:10029-10033; Riechmann et al., *Nature* (1988) 332:323-327). Illustrative methods for humanization of the anti-Fzd antibodies disclosed herein include the methods described in U.S. Pat. No. 7,462,697.

Another approach focuses not only on providing human-derived constant regions, but modifying the variable regions as well so as to reshape them as closely as possible to human form. It is known that the variable regions of both heavy and light chains contain three complementarity-determining regions (CDRs) which vary in response to the epitopes in question and determine binding capability, flanked by four framework regions (FRs) which are relatively conserved in a given species and which putatively provide a scaffolding for the CDRs. When nonhuman antibodies are prepared with respect to a particular epitope, the variable regions can be "reshaped" or "humanized" by grafting CDRs derived from nonhuman antibody on the FRs present in the human antibody to be modified. Application of this approach to various antibodies has been reported by Sato, K., et al., (1993) *Cancer Res* 53:851-856. Riechmann, L., et al., (1988) *Nature* 332:323-327; Verhoeyen, M., et al., (1988) *Science* 239:1534-1536; Kettleborough, C. A., et al., (1991) *Protein Engineering* 4:773-3783; Maeda, H., et al., (1991) *Human Antibodies Hybridoma* 2:124-134; Gorman, S. D., et al., (1991) *Proc Natl Acad Sci USA* 88:4181-4185; Tempest, P. R., et al., (1991) *Bio/Technology* 9:266-271; Co, M. S., et al., (1991) *Proc Natl Acad Sci USA* 88:2869-2873; Carter, P., et al., (1992) *Proc Natl Acad Sci USA* 89:4285-4289; and Co, M. S. et al., (1992) *J Immunol* 148:1149-1154. In some embodiments, humanized antibodies preserve all CDR sequences (for example, a humanized mouse antibody which contains all six CDRs from the mouse antibodies). In other embodiments, humanized antibodies have one or more CDRs (one, two, three, four, five, six) which are altered with respect to the original antibody, which are also termed one or more CDRs "derived from" one or more CDRs from the original antibody.

In certain embodiments, the antibodies of the present disclosure may be chimeric antibodies. In this regard, a chimeric antibody is comprised of an antigen-binding fragment of an antibody operably linked or otherwise fused to a heterologous Fc portion of a different antibody. In certain embodiments, the heterologous Fc domain is of human origin. In other embodiments, the heterologous Fc domain may be from a different Ig class from the parent antibody, including IgA (including subclasses IgA1 and IgA2), IgD, IgE, IgG (including subclasses IgG1, IgG2, IgG3, and IgG4), and IgM. In further embodiments, the heterologous Fc domain may be comprised of CH2 and CH3 domains from one or more of the different Ig classes. As noted above with regard to humanized antibodies, the antigen-binding fragment of a chimeric antibody may comprise only one or more of the CDRs of the antibodies described herein (e.g., 1, 2, 3, 4, 5, or 6 CDRs of the antibodies described herein), or may comprise an entire variable domain (VL, VH or both).

Wnt Surrogates

The disclosure provides, in certain aspects, Wnt surrogate molecules that bind both one or more Fzd receptors and one or both of LRP5 and/or LRP6. Wnt surrogate molecules may also be referred to as "Wnt surrogates" or "Wnt mimetics." In particular embodiments, the Wnt surrogate molecules bind one or more human Fzd receptors and one or both of a human LRP5 and/or a human LRP6.

In certain embodiments, a Wnt surrogate molecule is capable of modulating or modulates Wnt signaling events in a cell contacted with the Wnt surrogate molecule. In certain embodiments, the Wnt surrogate molecule increases Wnt signaling, e.g., via the canonical Wnt/β-catenin pathway. In certain embodiments, the Wnt surrogate molecule specifically modulates the biological activity of a human Wnt signaling pathway.

Wnt surrogate molecules of the present invention are biologically active in binding to one or more Fzd receptor and to one or more of LRP5 and LRP6, and in activation of Wnt signaling, i.e., the Wnt surrogate molecule is a Wnt agonist. The term "Wnt agonist activity" refers to the ability of an agonist to mimic the effect or activity of a Wnt protein binding to a frizzled protein and/or LRP5 or LRP6. The ability of the Wnt surrogate molecules and other Wnt agonists disclosed herein to mimic the activity of Wnt can be confirmed by a number of assays. Wnt agonists typically initiate a reaction or activity that is similar to or the same as that initiated by the receptor's natural ligand. In particular, the Wnt agonists disclosed herein activate, enhance or increase the canonical Wnt/β-catenin signaling pathway. As used herein, the term "enhances" refers to a measurable increase in the level of Wnt/β-catenin signaling compared with the level in the absence of a Wnt agonist, e.g., a Wnt surrogate molecule disclosed herein. In particular embodiments, the increase in the level of Wnt/β-catenin signaling is at least 10%, at least 20%, at least 50%, at least two-fold, at least five-fold, at least 10-fold, at least 20-fold, at least 50-fold, or at least 100-fold as compared to the level of Wnt/β-catenin signaling in the absence of the Wnt agonist, e.g., in the same cell type. Methods of measuring Wnt/β-catenin signaling are known in the art and include those described herein.

In particular embodiments, Wnt surrogate molecules disclosed herein are bispecific, i.e., they specifically bind to two or more different epitopes, e.g., one or more Fzd receptor, and LRP5 and/or LRP6.

In particular embodiments, Wnt surrogate molecules disclosed herein are multivalent, e.g., they comprise two or more regions that each specifically bind to the same epitope, e.g., two or more regions that bind to an epitope within one or more Fzd receptor and/or two or more regions that bind to an epitope within LRP5 and/or LRP6. In particular embodiments, they comprise two or more regions that bind to an epitope within one or more Fzd receptor and two or more regions that bind to an epitope within LRP5 and/or LRP6. In certain embodiments, Wnt surrogate molecules comprise a ratio of the number of regions that bind one or more Fzd receptor to the number of regions that bind LRP5 and/or LRP6 of or about: 1:1, 2:1, 3:1, 4:1, 5:1, 6:1, 2:3, 2:5, 2:7, 7:2, 5:2, 3:2, 3:4, 3:5, 3:7, 3:8, 8:3, 7:3, 5:3, 4:3, 4:5, 4:7, 4:9, 9:4, 7:4, 5:4, 6:7, 7:6, 1:2, 1:3, 1:4, 1:5, or 1:6. In certain embodiments, Wnt surrogate molecules are bispecific and multivalent.

Wnt surrogate molecules disclosed herein may have any of a variety of different structural formats or configurations. Wnt surrogate molecules may comprise polypeptides and/or non-polypeptide binding moieties, e.g., small molecules. In particular embodiments, Wnt surrogate molecules comprise both a polypeptide region and a non-polypeptide binding moiety. In certain embodiments, Wnt surrogate molecules may comprise a single polypeptide, or they may comprise two or more, three or more, or four or more polypeptides. In certain embodiments, one or more polypeptides of a Wnt surrogate molecule are antibodies or antigen-binding fragments thereof. In certain embodiments, Wnt surrogates comprise two antibodies or antigen binding fragments thereof, one that binds one or more Fzd and one that binds LRP5 and/or LRP6. In certain embodiments, the Wnt surrogates comprises one, two, three, or four polypeptides, e.g., linked or bound to each other or fused to each other.

When the Wnt surrogate molecules comprise a single polypeptide, they may be a fusion protein comprising one or more Fzd binding domain and one or more LRP5/6 binding domain. The binding domains may be directly fused or they may be connected via a linker, e.g., a polypeptide linker, including but not limited to any of those disclosed herein.

When the Wnt surrogate molecules comprise two or more polypeptides, the polypeptides may be linked via covalent bonds, such as, e.g., disulfide bonds, and/or noncovalent interactions. For example, heavy chains of human immunoglobulin IgG interact at the level of their CH3 domains directly, whereas, at the level of their CH2 domains, they interact via the carbohydrate attached to the asparagine (Asn) N84.4 in the DE turn. In particular embodiments, the Wnt surrogate molecules comprise one or more regions derived from an antibody or antigen-binding fragment thereof, e.g., antibody heavy chains or antibody light chains or fragments thereof. In certain embodiments, a Wnt surrogate polypeptide comprises two antibody heavy chain regions (e.g., hinge regions) bound together via one or more disulfide bond. In certain embodiments, a Wnt surrogate polypeptide comprises an antibody light chain region (e.g., a CL region) and an antibody heavy chain region (e.g., a $C_H1$ region) bound together via one or more disulfide bond.

Wnt surrogate polypeptides may be engineered to facilitate binding between two polypeptides. For example, Knob-into-holes amino acid modifications may be introduced into two different polypeptides to facilitate their binding. Knobs-into-holes amino acid (AA) changes is a rational design strategy developed in antibody engineering, used for heterodimerization of the heavy chains, in the production of bispecific IgG antibodies. AA changes are engineered in order to create a knob on the $C_H3$ of the heavy chains from a first antibody and a hole on the $C_H3$ of the heavy chains of a second antibody. The knob may be represented by a tyrosine (Y) that belongs to the 'very large' IMGT volume class of AA, whereas the hole may be represented by a threonine (T) that belongs to the 'small' IMGT volume class. Other means of introducing modifications into polypeptides to facilitate their binding are known and available in the art. For example, specific amino acids may be introduced and used for cross-linking, such as Cysteine to form an intermolecular disulfide bond.

Figure 1:
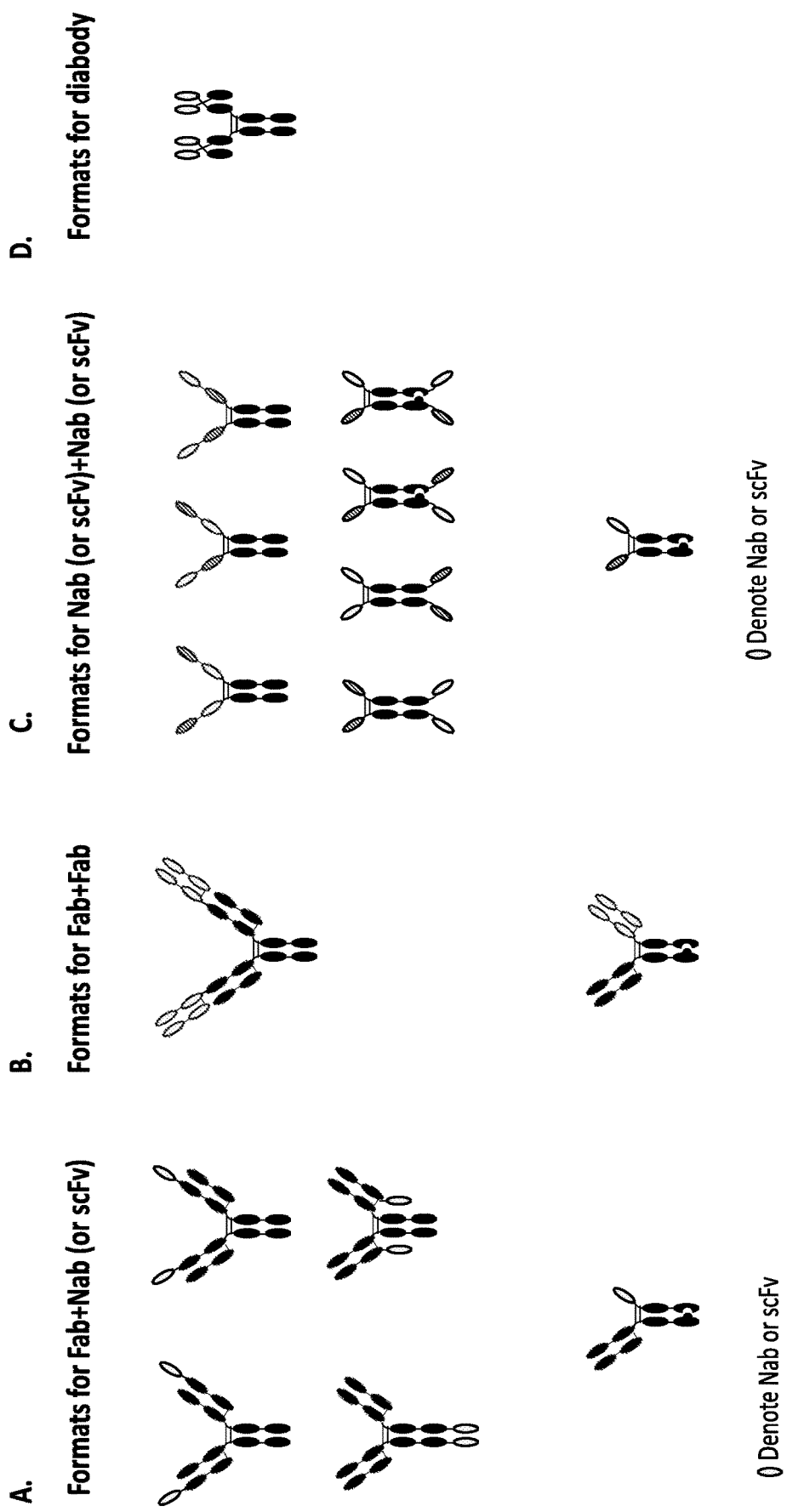
FIGS. 1A-D. Schematic diagrams of illustrative formats of Wnt surrogate molecules.

Wnt surrogate molecules may have a variety of different structural formats, including but not limited to those shown in FIG. 1.

In one embodiment, a Wnt surrogate molecule comprises an scFv or antigen-binding fragment thereof fused to a VHH or sdAb or antigen-binding fragment thereof. In certain embodiments, the scFv specifically binds one or more Fzd receptor, and the VHH or sdAb specifically binds LRP5 and/or LRP6. In certain embodiments, the scFv specifically binds LRP5 and/or LRP6, and the VHH or sdAb specifically binds one or more Fzd receptor. In particular embodiments, the scFv or antigen-binding fragment thereof is fused directly to the VHH or sdAb or antigen-binding fragment thereof, whereas in other embodiments, the two binding regions are fused via a linker moiety. In particular embodiments, the VHH or sdAb is fused to the N-terminus of the scFV, while in other embodiments, the VHH or sdAb is fused to the C-terminus of the scFv. In particular embodiments, the scFv is described herein or comprises any of the CDR sets described herein. In particular embodiments, the VHH or sdAb is described herein or comprises any of the CDR sets disclosed herein.

In various embodiments, including but not limited to those depicted in FIG. 1A, a Wnt surrogate molecule comprises one or more Fab or antigen-binding fragment thereof and one or more VHH or sdAb or antigen-binding fragment thereof (or alternatively, one or more scFv or antigen-binding fragment thereof). In certain embodiments, the Fab specifically binds one or more Fzd receptor, and the VHH or sdAb (or scFv) specifically binds LRP5 and/or LRP6. In certain embodiments, the Fab specifically binds LRP5 and/or LRP6, and the VHH or sdAb (or scFv) specifically binds one or more Fzd receptor. In certain embodiments, the VHH or sdAb (or scFv) is fused to the N-terminus of the Fab, while in some embodiments, the VHH or sdAb (or scFv) is fused to the C-terminus of the Fab. In particular embodiments, the Fab is present in a full IgG format, and the VHH or sdAb (or scFv) is fused to the N-terminus and/or C-terminus of the IgG light chain. In particular embodiments, the Fab is present in a full IgG format, and the VHH or sdAb (or scFv) is fused to the N-terminus and/or C-terminus of the IgG heavy chain. In particular embodiments, two or more VHH or sdAb (or scFvs) are fused to the IgG at any combination of these locations.

Fabs may be converted into a full IgG format that includes both the Fab and Fc fragments, for example, using genetic engineering to generate a fusion polypeptide comprising the Fab fused to an Fc region, i.e., the Fab is present in a full IgG format. The Fc region for the full IgG format may be derived from any of a variety of different Fcs, including but not limited to, a wild-type or modified IgG1, IgG2, IgG3, IgG4 or other isotype, e.g., wild-type or modified human IgG1, human IgG2, human IgG3, human IgG4, human IgG4Pro (comprising a mutation in core hinge region that prevents the formation of IgG4 half molecules), human IgA, human IgE, human IgM, or the modified IgG1 referred to as IgG1 LALAPG. The $L_{235}A$, $P_{329}G$ (LALA-PG) variant has been shown to eliminate complement binding and fixation as well as Fc-γ dependent antibody-dependent cell-mediated cytotoxity (ADCC) in both murine IgG2a and human IgG1. These LALA-PG substitutions allow a more accurate translation of results generated with an "effectorless" antibody framework scaffold between mice and primates. In particular embodiments of any of the IgG disclosed herein, the IgG comprises one or more of the following amino acid substitutions: N297G, N297A, N297E, L234A, L235A, or P236G.

Non-limiting examples of bivalent and bispecific Wnt surrogate molecules that are bivalent towards both the one or more Fzd receptor and the LRP5 and/or LRP6 are provided as the top four structures depicted in FIG. 1A, where the VHH or sdAb or scFv is depicted in white, and the Fab or IgG is depicted in black. As shown, the VHH or sdAb (or scFvs) may be fused to the N-termini of both light chains, to the N-termini of both heavy chains, to the C-termini of both light chains, or to the C-termini of both heavy chains. It is further contemplated, e.g., that VHH or sdAb (or scFvs) could be fused to both the N-termini and C-termini of the heavy and/or light chains, to the N-termini of the light chains and the heavy chains, to the C-termini of the heavy and light chains, to the N-termini of the heavy chains and C-termini of the light chains, or to the C-termini of the heavy chains and the N-termini of the light chains. In other related embodiments, two or more VHH or sdAb (or scFvs) may be fused together, optionally via a linker moiety, and fused to the Fab or IgG at one or more of these locations. In a related embodiment, the Wnt surrogate molecule has a Hetero-IgG format, whereas the Fab is present as a half antibody, and one or more VHH or sdAb (or scFv) is fused to one or more of the N-terminus of the Fc, the N-terminus of the Fab, the C-terminus of the Fc, or the C-terminus of the Fab. A bispecific but monovalent to each receptor version of this format is depicted at the bottom of FIG. 1A. In certain embodiments, the Fab or antigen-binding fragment (or IgG) thereof is fused directly to the VHH or sdAb (or scFv) or antigen-binding fragment thereof, whereas in other embodiments, the binding regions are fused via a linker moiety. In particular embodiments, the Fab is described herein or comprises any of the CDR sets described herein. In particular embodiments, the VHH or sdAb or scFv is described herein or comprises any of the CDR sets disclosed herein.

In various embodiments, including but not limited to those depicted in FIG. 1B, a Wnt surrogate molecule comprises one or more Fab or antigen-binding fragment thereof that binds one or more Fzd receptor and one or more Fab or antigen-binding fragment thereof that binds LRP5 and/or LRP6. In certain embodiments, it comprises two Fab or antigen-binding fragments thereof that bind one or more Fzd receptor and/or two Fab or antigen-binding fragments thereof that bind LRP5 and/or LRP6. In particular embodiments, one or more of the Fab is present in a full IgG format, and in certain embodiments, both Fab are present in a full IgG format. In certain embodiments, the Fab in full IgG format specifically binds one or more Fzd receptor, and the other Fab specifically binds LRP5 and/or LRP6. In certain embodiments, the Fab specifically binds one or more Fzd receptor, and the Fab in full IgG format specifically binds LRP5 and/or LRP6. In certain embodiments, the Fab specifically binds LRP5 and/or LRP6, and the Fab in full IgG format specifically binds one or more Fzd receptor. In certain embodiments, the Fab is fused to the N-terminus of the IgG, e.g., to the heavy chain or light chain N-terminus, optionally via a linker. In certain embodiments, the Fab is fused to the N-terminus of the heavy chain of the IgG and not fused to the light chain. In particular embodiments, the two heavy chains can be fused together directly or via a linker. An example of such a bispecific and bivalent with respect to both receptors is shown at the top of FIG. 1B. In other related embodiments, two or more VHH or sdAb may be fused together, optionally via a linker moiety, and fused to the Fab or IgG at one or more of these locations. In a related embodiment, the Wnt surrogate molecule has a Hetero-IgG format, whereas one of the Fab is present as a half antibody, and the other Fab is fused to one or more of the N-terminus of the Fc, the N-terminus of the Fab, or the C-terminus of the Fc. A bispecific but monovalent to each receptor version of this format is depicted at the bottom of FIG. 1B. In certain embodiments, the Fab or antigen-binding fragment thereof is fused directly to the other Fab or IgG or antigen-binding fragment thereof, whereas in other embodiments, the binding regions are fused via a linker moiety. In particular embodiments, the one or both of the two Fabs are described herein or comprise any of the CDR sets described herein.

In certain embodiments, Wnt surrogate molecules have a format as described in PCT Application Publication No. WO2017/136820, e.g., a Fabs-in-tandem IgG (FIT-IG) format. Shiyong Gong, Fang Ren, Danqing Wu, Xuan Wu & Chengbin Wu (2017). FIT-IG also include the formats disclosed in "Fabs-in-tandem immunoglobulin is a novel and versatile bispecific design for engaging multiple therapeutic targets" mAbs, 9:7, 1118-1128, DOI: 10.1080/19420862.2017.1345401. In certain embodiments, FIT-IGs combine the functions of two antibodies into one molecule by re-arranging the DNA sequences of two parental monoclonal antibodies into two or three constructs and co-expressing them in mammalian cells. Examples of FIT-IG formats and constructs are provided in FIGS. 1A and 1B and FIGS. 2A and 2B of PCT Application Publication No. WO2017/136820. In certain embodiments, FIT-IGs require no Fc mutation; no scFv elements; and no linker or peptide connector. The Fab-domains in each arm work "in tandem" forming a tetravalent bi-specific antibody with four active and independent antigen binding sites that retain the biological function of their parental antibodies In particular embodiments, Wnt surrogates comprises a Fab and an IgG. In certain embodiments, the Fab binder LC is fused to the HC of the IgG, e.g., by a linker of various length in between. In various embodiment, the Fab binder HC can be fused or unfused to the LC of the IgG. A variation of this format has been called Fabs-in-tandem IgG (or FIT-Ig).

In particular embodiments, Wnt surrogate molecules comprise two or more VHH or sdAb (or scFvs), including at least one that binds one or more Fzd receptor and at least one that binds LRP5 and/or LRP6. In certain embodiments, one of the binding regions is a VHH or sdAb and the other is an scFv. Wnt memetic molecules comprising two or more VHH or sdAb (or scFvs) may be formatted in a variety of configurations, including but not limited to those depicted in FIG. 1C. In certain bispecific, bivalent formats, two or more VHH or sdAb (or scFvs) are fused in tandem or fused to two different ends of an Fc, optionally via one or more linkers. Where linkers are present, the linker and its length may be the same or different between the VHH or sdAb (or scFv) and the other VHH or sdAb (or scFv), or between the VHH or sdAb and Fc. For example, in certain embodiments, the VHH or sdAb is fused to the N-terminus and/or C-terminus of the IgG heavy chain. In particular embodiments, two or more VHH or sdAb are fused to the IgG at any combination of these locations. Non-limiting examples of bivalent and bispecific Wnt surrogate molecules of this format are depicted as the top seven structures depicted in FIG. 1C, where the first VHH or sdAb is depicted in white, the Fc or IgG is depicted in black, and the second VHH or sdAb is depicted as light gray. In various embodiments, both VHH or sdAb may be fused to the N-termini of the Fc, to the C-termini of the Fc, or one or more VHH or sdAb may be fused to either or both of an N-terminus or C-terminus of the Fc. In a related embodiment, the Wnt surrogate molecule has a Hetero-IgG format, whereas one VHH or sdAb is present as a half antibody, and the other is fused to the N-terminus of the Fc or the C-terminus of the Fc. A bispecific but monovalent to each receptor version of this format is depicted at the bottom of FIG. 1C. In certain embodiments, the VHH or sdAb is fused directly to the other VHH or sdAb whereas in other embodiments, the binding regions are fused via a linker moiety. In particular embodiments, the VHH or sdAb are described herein or comprises any of the CDR sets described herein. In various embodiments, any of these formats may comprise one or more scFvs in place of one or more VHH or sdAb.

In certain embodiments, a Wnt surrogate molecule is formatted as a diabody. As shown in FIG. 1D, the binders against Fzd and LRP can also be linked together in a diabody (or DART) configuration. The diabody can also be in a single chain configuration. If the diabody is fused to an Fc, this will create a bivalent bispecific format. Without fusion to Fc, this would be a monovalent bispecific format. In certain embodiments; a diabody is a noncovalent dimer scFv fragment that consists of the heavy-chain variable (VH) and light-chain variable (VL) regions connected by a small peptide linker. Another form of diabody is a single-chain (Fv)2 in which two scFv fragments are covalently linked to each other.

As discussed, Wnt surrogate molecules, in various embodiments, comprise one or more antibodies or antigen-binding fragments thereof disclosed herein. Thus, in particular embodiments, a Wnt surrogate comprises two polypeptides, wherein each polypeptide comprises an Nab or scFv that binds LRP5/6 and an Nab or scFv that binds one or more Wnts, optionally wherein one of the binding domains is an scFv and the other is an Nab. In certain embodiments, a Wnt surrogate comprises three polypeptides, wherein the first polypeptide comprises an antibody heavy chain and the second polypeptide comprises an antibody light chain, wherein the antibody heavy chain and light chain bind LRP5/6 or one or more Fzds, and wherein the third polypeptide comprises a VHH or sdAb fused to a heavy chain Fc region, wherein the VHH or sdAb binds to either LRP5/6 or one or more Fzds. In other embodiments, Wnt polypeptides comprise four polypeptides, including two heavy chain polypeptides and two light chain polypeptides, wherein the two heavy chains and two light chains bind LRP5/6 or one or more Fzds, and further comprise one or more Nab or scFv fused to one or more of the heavy chains and/or light chains, wherein the Nab or scFv binds to LRP5/6 or one or more Fzds. In another illustrative embodiment, a Wnt surrogate comprises at least four polypeptides, including two heavy chain polypeptides and two light chain polypeptides that bind either LRP5/6 or one or more Fzds, wherein the Wnt surrogate further comprises a Fab that binds either LRP5/6 or one or more Fzds. For example, the Fab may comprise two polypeptides, each fused to one of the two heavy chain polypeptides, and two polypeptides, each fused to one of the two light chain polypeptides, or it may comprise two polypeptides each fused to one of the two heavy chain polypeptides and two additional polypeptides, each bound to one of the two polypeptides fused to the heavy chain polypeptides, thus making a second Fab. Other configurations may be used to produce the Wnt surrogates disclosed herein.

In particular embodiments, a Wnt surrogate molecule comprises a Fzd binding region, e.g., an anti-Fzd antibody, or antigen-binding fragment thereof, fused or bound to a polypeptide that specifically binds to one or more Fzd receptor. In particular embodiments, the polypeptide that specifically binds to one or more Fzd receptor is an antibody or antigen-binding fragment thereof. If certain embodiments, it is an antibody or antigen-binding fragment thereof disclosed herein or in the U.S. provisional patent application Ser. No. 62/607,877, titled, "Anti-Frizzled antibodies and Methods of Use," filed on Dec. 19, 2017, which is incorporated herein by reference in its entirety. In particular embodiments, the Fzd binding domain comprises the three heavy chain CDRs and/or the three light chain CDRs disclosed for any of the illustrative antibodies or fragments thereof that bind to one or more Fzd receptor provided in Table 1A. In particular embodiments, the Fzd binding domain comprises the three heavy chain CDRs and/or the three light chain CDRs disclosed for any of the illustrative antibodies or fragments thereof that bind to one or more Fzd receptor provided in Table 1A, wherein the CDRs collectively comprise one, two, three, four, five, six, seven, or eight amino acid modifications, e.g., substitutions, deletions, or additions. In certain embodiments, the Fzd binding domain is a VHH or sdAb or was derived from a VHH or sdAb, so Table 1A only includes the three heavy chain CDRs. In particular embodiments, the Fzd binding domain comprises the three CDR HC sequences provided in Table 1A or variants wherein the CDRs collectively comprise one, two, three, four, five, six, seven or eight amino acid modifications. In particular embodiments, the Fzd binding domain comprises the heavy chain fragment and/or light chain fragment of any of the illustrative antibodies or fragments thereof that bind to one or more Fzd receptor provided in Table 1B or SEQ ID NOs:1-65 or 129-132 (or an antigen-binding fragment or variant of either). In certain embodiments, the Fzd binding domain is an Fab or was derived from an Fab, so the heavy chain of Table 1B includes VH and CH1 sequence, but not CH2 or CH3 sequences. In certain embodiments, the Fzd binding domain is a VHH or sdAb or was derived from a VHH or sdAb, so Table 1B includes the VHH domain. In certain embodiments, the Fzd binding region is a polypeptide, e.g., an antibody or antigen-binding fragment thereof, that competes with any of these antibodies for binding to one or more Fzd receptor.

TABLE 1A

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 001S-A01 | Fzd1 | YTFTSYGIS | 391 | GWISAYNGNTNYA | 570 | CARASAWTPYGAFDIW | 752 | SGSSSNIGSHTVS | 1156 | SNYQRPS | 1256 | CAAWDGSLFGHWVT | 1265 |
| 001S-B01 | Fzd1 | GSISSGGYSWS | 283 | GSIYHSGSTYYN | 547 | CARFYYDILTGYSYFDYW | 818 | RSSRSLLDTDDGNTYLD | 1142 | TLSHRAS | 1259 | CMQSIQLPWTF | 1295 |
| 001S-E01 | Fzd1 | GSISNYYWS | 282 | GEIDRSGDTNYN | 488 | CARVRARRFLVSDRSAFDIW | 945 | SGNTLGSHYVS | 1155 | QDSKRPS | 1246 | CQVWDSSTVVF | 1431 |
| 001S-F01 | Fzd1 | GSISGNNYYZG | 281 | GSIYFTGGTYYN | 546 | CARVMLITDAFDIW | 942 | RSSQSLLHSNGYNYLD | 1138 | LGSNRAS | 1237 | CMQGTHWPYTF | 1289 |
| 001S-G01 | Fzd1 | GSISSSYYWG | 285 | GYIYYSGSTYYN | 589 | CARATYGGDAFDIWH | 760 | TRSSSNIGAGYDV | 1161 | GNSIRPS | 1220 | CGTWDSSLSAWVF | 1267 |
| 001S-H01 | Fzd1 | GSISSGGYYWS | 284 | GYIYYSGSTYYN | 589 | CARHAGFYGLADYFDYW | 875 | RSSQSLLHSNGYNYLD | 1138 | LGSKRAS | 1236 | CMQALQIPPTF | 1280 |
| 001S-A02 | Fzd1 | GSISSGGYYWS | 284 | GYIYYSGSTYYN | 589 | CARGKGYSYGYGKDWFDPW | 845 | QASQDIGKYLN | 1041 | DASNLET | 1185 | CQQNDYLPLTF | 1332 |
| 001S-E02 | Fzd1 | GSISGNNYYWG | 280 | GSIYFTGGTYYN | 546 | CARVMLITDAFDIW | 942 | RSSQSLLHSNGYNYLD | 1138 | LGSNRAS | 1237 | CMQGTHWPYTF | 1289 |
| 001S-G02 | Fzd1 | GAISGTSYFWG | 266 | GSIYYTGNTYYN | 548 | CARIGIAVAAPVDHW | 882 | RASQSVGTYLT | 1110 | DASNRAT | 1188 | CMQATQFPLTF | 1284 |
| 001S-H02 | Fzd1 | GSISSSYYWG | 285 | GYIYYSGSTYYN | 589 | CARATYGGDAFDIW | 760 | TRSSSNIGAGYDVH | 1161 | GNSIRPS | 1220 | CGTWDSSLSAWVF | 1267 |
| 001S-A03 | Fzd1 | GSISSGGYYWS | 284 | GYIYYSGSTYYN | 589 | CARVRDYYDSSGYYYDYFDYW | 946 | RASRSISSYFN | 1128 | AASSLQS | 1175 | CQQADTFPPTF | 1314 |
| 001S-B03 | Fzd1 | ASFSGHYWT | 158 | GEIDHTGSTNYE | 487 | CARGGQGGYDWGHYHGLDVW | 835 | SGDKVGHKYAS | 1154 | EDSQRPS | 1199 | CQAWDSSTDVVF | 1301 |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 001S-H08 | Fzd5 | RAFTDNVMA | 329 | ATISGGGSTFDD | 466 | CAAASSLTSTPYDLW | 678 | | | | | | |
| 001S-A09 | Fzd5 | RSFRTNALG | 333 | AAISWTGGSTYYA | 422 | CNTVTYTGGSYKNYW | 1005 | | | | | | |
| 001S-B09 | Fzd5 | SIDSINAMA | 356 | AALTSGGITYHA | 428 | CNVITIVRGMGPRAYW | 1006 | | | | | | |
| 001S-C09 | Fzd5 | SIFSINAMG | 357 | ATIQSGGRTNYA | 465 | CNVITIVRGMGPRAYW | 1006 | | | | | | |
| 001S-C07 | Fzd8 | YTFTSYGIS | 391 | GWISAYNGNTNYA | 570 | CARDGTPFYSGSYYGSW | 772 | QGDSLRTYYAS | 1052 | GKNNRPS | 1219 | CNSRDNSGKHKVF | 1300 |
| 001S-D07 | Fzd8 | GTFSSYAIS | 295 | GRIIPILGIANYA | 529 | CARVPTSPYDILTGPFDYW | 944 | RSSQSLLHSNGFNYVD | 1136 | FGSYRAS | 1206 | CMQNLQTPWTF | 1291 |
| 001S-E07 | Fzd8 | ASVSSNSAAWN | 159 | YRSKWYNDYA | 542 | CARWKNYFDPW | 953 | RASQGIRSDLA | 1070 | AASTLES | 1177 | CLQDYSYPRTF | 1273 |
| 001S-H07 | Fzd8 | FTFSSYAMS | 228 | STISGGGSTYYA | 646 | CAKDLVPWGSSAFNIW | 704 | RASQSVSSYLA | 1121 | GASSRAT | 1213 | CQQYGSSPPTF | 1410 |
| 004S-E05 | Fzd5 | FTFSTYEMN | 243 | SGVSWNGSRTHYV | 618 | CARGQSEKWWSGLYGMDVW | 856 | RASQGISSALA | 1076 | AASALQS | 1165 | CQQTYSTPRTF | 1394 |
| 004S-E03 | Fzd5 | GTFSTYAIS | 298 | GWINSGNGNTKYS | 565 | CWTGLLWFGESTDAFDIW | 1031 | RASQSISSYLN | 1098 | AASSLQS | 1175 | CQQSYSTPLTF | 1372 |
| 004S-G06 | Fzd5 | GTFTYRYLH | 307 | GGIIPIFGTGNYA | 501 | CASSMVRVPYYYGMDVW | 964 | RASQSISSYLN | 1098 | AASSLQS | 1175 | CQQSYSTPLTF | 1372 |
| 001S-D09 | Fzd8 | GPFNLFAMG | 272 | AGISRTGGNTGYA | 445 | CASKTTINSGWSREYHYW | 958 | | | | | | |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 001S-E09 | Fzd8 | GPFNLFAMG | 272 | AGISRTGGNTGYA | 445 | CASKTTINSGWSREYHYW | 958 | | | | | | |
| 001S-F09 | Fzd8 | GFFSSFTMG | 268 | AAISRNGVYTRFA | 409 | CNALAPGVRGSW | 987 | | | | | | |
| 001S-G09 | Fzd8 | SLFRLNGM | 360 | ATISTRGTTHYA | 467 | CTDEESW | 1011 | | | | | | |
| 001S-H09 | Fzd8 | GPFNLLAMG | 273 | AGISRTGGNTGYA | 445 | CASKTTINSGWSREYHYW | 958 | | | | | | |
| 001S-A10 | Fzd8 | SVVNFVVMG | 364 | AAITSGGSTNYA | 425 | CNRVGSREYSYW | 1001 | | | | | | |
| 001S-B10 | Fzd8 | AAIGRTSDLYTMG | 352 | YKVKWNGERTYYL | 404 | CNAVTYNGYTIW | 994 | | | | | | |
| 001S-G12 | Fzd1 | SIFSSNTIY | 359 | ALITTSGNTNYA | 455 | CNAGAPAWTYRMGTYYPQFGSW | 986 | | | | | | |
| 002S-A01 | Fzd1 | STFSTYAMG | 362 | AAISGSGENTYYA | 408 | CVKFGMNLGYSGYDYW | 1028 | | | | | | |
| 002S-B01 | Fzd1 | STFSNYAMG | 361 | AAISWGGGSTFYS | 411 | CAAGPIARWYRGDMDYW | 681 | | | | | | |
| 002S-C01 | Fzd1 | RMFSNYAMG | 331 | AAISSGGSGTYYS | 410 | CAAGPIARWYRGDMDYW | 681 | | | | | | |
| 002S-D01 | Fzd1 | RTDGGYVMG | 337 | ATVTWRTGTTYYA | 469 | CAAGPIARWYRGDMDYW | 681 | | | | | | |
| 002S-E01 | Fzd1 | RTFSSAAMG | 345 | AAISWSGSTAYYA | 421 | CATLTPYGTVASY | 974 | | | | | | |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 002S-F01 | Fzd1 | RTFSSYAMG | 347 | AAVNWSGGSTYYA | 430 | CAAVFLSRNYEIQEYYRYQ | 689 | | | | | | |
| 002S-G01 | Fzd1 | RTFSSYAMG | 347 | AAISWSGGSTYYA | 418 | CAAGPIARWYRGDMDYW | 681 | | | | | | |
| 002S-H01 | Fzd1 | RSFSTYPMG | 336 | TVISGSGGSTYYS | 676 | CAAGPIARWYRGDMDYW | 681 | | | | | | |
| 002S-A02 | Fzd1 | RRFTTYGMG | 332 | AAVTWRSGSTYYA | 436 | CYLEGPLDVYW | 1032 | | | | | | |
| 002S-B02 | Fzd1 | RTFNRHVMG | 341 | AAISWSGDSTYYA | 415 | CAKLGGSSWLREYDYW | 724 | | | | | | |
| 002S-C02 | Fzd1 | RTFRAYAMG | 342 | SAISWSGGSTYYA | 603 | CAAGPIARWYRGDMDYW | 681 | | | | | | |
| 002S-D02 | Fzd1 | RTFSEYAMG | 343 | AAISWSGGSTHYA | 417 | CNADSLRGIDYW | 984 | | | | | | |
| 002S-E02 | Fzd1 | FTFREYAMT | 199 | SGISRDGGRTSYS | 613 | CAPRVLVTAPSGGMDYW | 734 | | | | | | |
| 002S-F02 | Fzd1 | GDFTNYAMA | 267 | AAVNWRGDGTYYS | 429 | CAAVFLSRNYEIQEYYRYQ | 689 | | | | | | |
| 002S-G02 | Fzd1 | RTFGTWAMG | 340 | AAISYNGFSTYYS | 424 | CAAGPIARWYRGDMDYW | 681 | | | | | | |
| 002S-H02 | Fzd1 | RTFSSYAMG | 347 | AAISWSGGSTYYA | 418 | CAAGPIARWYRGDMDYW | 681 | | | | | | |
| 002S-D03 | Fzd1 | RTFGSYAMG | 339 | AAISWSGGSTYYA | 418 | CAAGPIARWYRGDMDYW | 681 | | | | | | |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 002S-E03 | Fzd1 | SIFSIYAMG | 358 | AVVATGGATNYA | 481 | CNMRGNWYREGRPAEFLSW | 1000 | | | | | | |
| 002S-F03 | Fzd1 | RTSSSYAMG | 353 | AAISWSGGSTYYA | 418 | CAAGPIARWYRGDMDYW | 681 | | | | | | |
| 002S-G03 | Fzd1 | RTFGSYAMG | 339 | AAISWSGGSTYYA | 418 | CAAGPIARWYRGDMDYW | 681 | | | | | | |
| 002S-H03 | Fzd1 | QTFTAYAMG | 327 | AAISWSGSATHYA | 420 | CNAWVLVAGSRGTSADYW | 996 | | | | | | |
| 002S-A04 | Fzd1 | RTFSSYAMG | 347 | AAISWSGRSTYYA | 419 | CAAGPIARWYRGDMDYW | 681 | | | | | | |
| 002S-B04 | Fzd1 | RTFSSYAMG | 347 | AAISWSGGSTYYA | 418 | CAAGPNYSWFMPSSSRLIW | 682 | | | | | | |
| 002S-C04 | Fzd1 | RRFTTYGMG | 332 | AAVTWRAGSTYYA | 435 | CSADKLDYLDDQPFKTWDYW | 1010 | | | | | | |
| 002S-D04 | Fzd1 | GTSSTYAMG | 309 | AAINRSGGSTYYA | 405 | CAAVFLSRNYEIQEYYRYQ | 689 | | | | | | |
| 002S-E04 | Fzd1 | GTFSTYAMG | 300 | AAISWSGDSTYYL | 416 | CAAGPIARWYRGDMDYW | 681 | | | | | | |
| 004S-H04 | Fzd5 | GTFSSYAIS | 295 | GWISTYNGATNYA | 577 | CARGGAGRFGEGMDVW | 826 | RASQSISSYLN | 1098 | AASSLQS | 1175 | CQQSYSTPLTF | 1372 |
| 001S-A04 | Fzd5 | YTFTSYGIS | 391 | GWISAYNGNTNYA | 577 | CASSKEKATYYYGMDVW | 963 | GLSSGSVSTNYYPS | 1035 | YTNTRSS | 1263 | CLLYLGRGIWVF | 1271 |
| 001S-D03 | Fzd5 | GTFSSYAIS | 295 | GRIIPILGIANYA | 529 | CARLDPGYYYGMDVW | 886 | TGTSSDVGGYNSVS | 1159 | DVTKRPS | 1196 | CFSYAGSRFGSRF | 1266 |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 001S-F03 | Fzd5 | GTFSSYAIS | 295 | GGIIPIFGTANYA | 499 | CARVIFSTVTTTNDIW | 939 | TRSSGSIASNYVQ | 1160 | ENDKRPS | 1202 | CQSYDYDHRWVF | 1430 |
| 004S-E04 | Fzd5 | YTFSGYYLH | 374 | GTVTPILGTANYA | 549 | CARVDGSGYYGIDYW | 933 | RASQSISSYLN | 1098 | AASSLQS | 1175 | CQQSYSTPLTF | 1372 |
| 004S-A06 | Fzd5 | GSFSNYAIS | 278 | GRIIPILGSANYA | 530 | CARTYLKAFDIW | 930 | RASQSISSYLN | 1098 | AASSLQS | 1175 | CQQSYSTPLTF | 1372 |
| 004S-F04 | Fzd5 | YTFTNNFMH | 383 | GRINPNSGGTNYA | 537 | CARDRFDNWFDPW | 788 | RASQGISSALA | 1076 | AASTLQS | 1179 | CQQSYNTPWTF | 1351 |
| 001S-C03 | Fzd5 | GTFSSYAIS | 295 | GRIIPILGIANYA | 529 | CAREGRSRVYGGNSFDYW | 808 | RSSQSLLRRNGHNYVD | 1139 | MGSNRAP | 1238 | CMHGLHPPFTF | 1279 |
| 003S-A01 | Fzd1 | YIFTDYYMH | 368 | GGIIPIFGTANYA | 499 | CARMSSDYYDSSGYYRGMDVW | 895 | RASQGISNNLN | 1072 | GASTLQS | 1215 | CQQADSFPPTF | 1312 |
| 003S-E01 | Fzd1 | YIFTDYYMH | 368 | GGIIPIFGTANYA | 499 | CARAWKGLWFGEGTFDYW | 761 | RASQSISSYLN | 1098 | AASSLQS | 1175 | CQQSYSTPLTF | 1372 |
| 003S-F01 | Fzd1 | GTFSSYAIS | 295 | GWINAGNGNTTYA | 558 | CARLAFDIW | 885 | RASQSISSYLN | 1098 | AASSLQS | 1175 | CQQSYSTPLTF | 1372 |
| 003S-A02 | Fzd1 | YTFTGYYMH | 379 | GWINAGNGNTTYA | 558 | CAKDRGNYGDYLDYW | 707 | RASQGISNYLA | 1074 | EVSSVQG | 1204 | CQQSYSTPLAF | 1370 |
| 003S-C02 | Fzd1 | FTFSNSDMN | 214 | ALISYDGSHTYYA | 454 | CTRGSRIGWFDPW | 1015 | RASQSIGRWLA | 1084 | AASRLQS | 1171 | CQQGFNFPLTF | 1325 |
| 003S-E02 | Fzd1 | GTFSSYTIS | 296 | GGIIPISGKTDYA | 505 | CARARGGDSPLSL | 749 | RASQGISNNLN | 1072 | TASSLQS | 1258 | CLQDYSYPYTF | 1274 |
| 003S-F02 | Fzd1 | GTFRSYAIN | 292 | GGIIPIFGTANYA | 499 | CARGGWRPDYYGSGSYYSFDYW | 840 | RASQSVSSDLA | 1115 | GASTRAT | 1217 | CQQYETWPVLTF | 1405 |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 003S-G02 | Fzd1 | FTFGTYWVT | 196 | SGITGSGGRTFYA | 616 | CARMKDWFGAFDIW | 894 | RASESVSSSSFA | 1056 | GASTRAT | 1217 | CQQYNNWPPNYTF | 1420 |
| 003S-C03 | Fzd1 | FTFSRYAMS | 220 | SYISGDSGYTNYA | 658 | CARGLVIATNWFDPW | 849 | QANQDISNYLN | 1038 | AASSLQS | 1175 | CQQTYNPPRTF | 1389 |
| 003S-D03 | Fzd1 | YTFTSYYMH | 392 | GWINTYNGNTNYP | 567 | CAESLTSTADW | 691 | RASQGISNNLN | 1072 | AASSLQR | 1174 | CQQSYSTPFTF | 1368 |
| 003S-E03 | Fzd1 | YIFTDYYMH | 368 | NPTTGNTGYA | 586 | CARNVEGATSFPEFDYW | 898 | RASQGISNNLN | 1072 | SASNLQS | 1252 | CQQSYSPPPYTF | 1364 |
| 003S-H03 | Fzd1 | GTFSSYAIS | 295 | GGIIPIFGTANYA | 499 | CAKDIGSSWYYYMDVW | 701 | RASQSISSYLN | 1098 | AASSLQS | 1175 | CQQSYSTPLTF | 1372 |
| 003S-A04 | Fzd1 | FTFGTYWVT | 196 | SGITGSGGRTFYA | 616 | CARMKDWFGAFDIW | 894 | RTSERSSISSFA | 1148 | GASTRAT | 1217 | CQQYNNWPRNYTF | 1420 |
| 003S-C04 | Fzd1 | FAVSSYMS | 168 | ASIWFDGSNQDYA | 463 | CAPNESGNVDYW | 733 | RASQGISNNLN | 1072 | KASSLEN | 1225 | CQQSYSTPHTF | 1339 |
| 003S-D04 | Fzd1 | FTFSSYAMH | 227 | SAISGSGGSTYYA | 600 | CARDHGSSWYQNTDAFDIW | 774 | QASQDIGNYLN | 1042 | DVSNLER | 1195 | CQHLNSYPPGDTF | 1304 |
| 003S-G04 | Fzd1 | FRFISHPIH | 177 | GRVIPILGVTNYA | 545 | CASSSDYGDYLKEPNYGMDVW | 966 | RASQSISSYLN | 1098 | AASSLQS | 1175 | CQQSYSTPLTF | 1372 |
| 003S-D05 | Fzd2 | FTFSNYAMT | 216 | SAIGTGGGTYYA | 595 | CATAYRRPGGLDVW | 969 | RSSQSLLHSDGKTYLY | 1134 | LGSNRAS | 1237 | CMQNTHWPLTR | 1293 |
| 003S-E05 | Fzd2 | FTFSSYTMS | 236 | GRIKSKANGTTDYA | 535 | CARGSSSWYDW | 863 | KSSQSLLHSDGKTYLY | 1036 | LGSNRAS | 1237 | CMQNTHWPLTR | 1293 |
| 003S-A06 | Fzd2 | FTFADYGMH | 188 | SYISSGSYTIYYS | 659 | CARGTFDWLLSPSYDYW | 865 | RASQGISNNLN | 1072 | AASRLES | 1170 | CQQSYSTPLTF | 1372 |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 003S-C06 | Fzd2 | FTFSNYGMH | 217 | SAISNSGGSTYYA | 601 | CTSSFLTGSQPSGYW | 1018 | RASQDISSYLA | 1065 | AASSLQS | 1175 | CQQSYRTPLTF | 1353 |
| 003S-G06 | Fzd2 | FTFSDYGMH | 207 | SSTSGSGGNSKYS | 642 | CARHNPGYMGYYYGMDVW | 877 | RASQSVSSNLA | 1116 | DASNRAT | 1188 | CQHRTSWPLTF | 1307 |
| 003S-H06 | Fzd2 | GTFSSYTIS | 296 | GLVDPEDGETIYA | 520 | CTILPAAAAGTYYYYGMDVW | 1012 | RASQRVGNNLA | 1083 | DASIRAT | 1184 | CQQYKDWPTF | 1415 |
| 003S-B07 | Fzd2 | FTFSDHYMS | 205 | SSITRTPSGGTTEYA | 639 | CARDGGYW | 768 | RASQSVGSYLA | 1109 | GSSNRAA | 1221 | CQQYGTSLLTF | 1414 |
| 003S-D07 | Fzd2 | YTFTNNFMH | 383 | GIINPSGGSTSYA | 513 | RRYCSSTSCYPRDAFDIW | 759 | QASQGISNNLN | 1049 | LGSDRAS | 1233 | CQQSYSTPFTF | 1368 |
| 003S-E07 | Fzd2 | YTFTNNFMH | 383 | GWINPNSGGTKYA | 563 | CARSVGEVGATMLGIGVWYWFDPW | 926 | RASQSISSYLN | 1098 | AASSLQS | 1175 | CQQSYSTPFTF | 1368 |
| 003S-A08 | Fzd2 | FTFSNYAMT | 216 | SAIGTGGGTYYA | 595 | CATAYRRPGGLDVW | 969 | RSSQSLLHSDGKTYLY | 1134 | LGFNRAS | 1232 | CMQNTHWPLTR | 1293 |
| 003S-C08 | Fzd2 | LTVSTNFMS | 324 | AGIGWDSTNIGYA | 440 | CARDLVAARPSNWDYW | 782 | RASQGIRNDLG | 1069 | GASTLQR | 1214 | CQQSYSTPRVTF | 1374 |
| 003S-E08 | Fzd2 | FTFRNSAMH | 201 | STISGSGGSTYYS | 647 | CARGGGYSSSW | 829 | RSSRSLLHSDGKTYLY | 1143 | LGSNRAS | 1237 | CMQSSHWPKTF | 1298 |
| 003S-G09 | Fzd4 | FTFDHNPMN | 194 | SAIGAGGGTYYA | 593 | CASPTVTR | 960 | RASQSISSYLN | 1098 | AASSLQS | 1175 | CQQSYSTPLTF | 1372 |
| 003S-C10 | Fzd4 | GTFSSYAIS | 295 | GWINAGNGNTTYA | 558 | CARHYYGSGSYPDW | 880 | RASQSISSYLN | 1098 | AASSLQS | 1175 | CQQSYSTPLTF | 1372 |
| 003S-D10 | Fzd4 | FNFGIYSMT | 172 | SYISGDSGYTNYA | 658 | CARVGPGGWFDPW | 936 | RASQGISSYLA | 1076 | AASNLLG | 1167 | CQQTYSTPWTF | 1396 |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 003S-E10 | Fzd4 | FTFSSYAMH | 227 | AGISASGGSTYYA | 442 | CARPSTTGTKAFDIW | 901 | RASQSIGSNLD | 1085 | AASTLET | 1178 | CQQSYSVPDTF | 1380 |
| 003S-A11 | Fzd4 | GTFSSYAIS | 295 | GWINAGNGNTTYA | 558 | CARHYYGSGSYPDW | 880 | RASQSISZYZN | 1103 | ZASSLQS | 1264 | CQQSYSTPLTF | 1372 |
| 003S-G11 | Fzd4 | GTFSSYAIS | 295 | GRIIPIFGTVNYA | 528 | CARGARLDYW | 820 | RASQSISSYLN | 1098 | AASSLQS | 1175 | CQQSYSTPLTF | 1372 |
| 003S-H11 | Fzd4 | YTFTGYYMH | 379 | GGIIPIFGTPHYA | 502 | CASTDPSSGLDYW | 967 | RASQSIGSNLD | 1085 | DASSLES | 1189 | CQQSFIMPLTF | 1341 |
| 003S-C12 | Fzd4 | GTFSSYAIS | 295 | GWINPNSGGTNYA | 564 | CARGGSSDVR | 838 | RASQSISSYLN | 1098 | AASSLQS | 1175 | CQQSYSTPLTF | 1372 |
| 003S-F12 | Fzd4 | FTFSSYAMH | 227 | SVISTSGDTVLYT | 652 | CARGGSSDVR | 838 | RASQSISSYLN | 1098 | AASSLQS | 1175 | CQQSYSTPLTF | 1372 |
| 004S-B01 | Fzd4 | GTFSSYAIS | 295 | GIINPSGGSTSYA | 513 | CAKDGVVR | 698 | RAIQSISSYLN | 1054 | AASSLQS | 1175 | CQQSYSTPLTF | 1372 |
| 004S-C01 | Fzd4 | FTFSNHYTS | 213 | STISSSGGRTFYA | 650 | CARASRIDGGWPIIDHL | 754 | RASQDIRDELA | 1062 | AASTLQS | 1179 | CQQADSFPLTF | 1311 |
| 004S-D01 | Fzd4 | FTFTNYAMS | 248 | SAISGSGGSTYYA | 600 | CARATGFGTVVFDYW | 757 | RASQSISSYLN | 1098 | AASSLQS | 1175 | CQQSYSTPLTF | 1372 |
| 004S-E01 | Fzd4 | GTFSSYAIS | 295 | GWINAGNGNTTYA | 558 | CARHYYGSGSYPDW | 880 | ZACLRIISYLN | 1163 | FASSLQS | 1205 | CQQSYSTPLTF | 1372 |
| 004F-F01 | Fzd4 | GTFSSYAIS | 295 | GWINAGNGNTTYA | 558 | CARDGVE | 773 | RASQGISNWLA | 1073 | DASSLQS | 1190 | CQQSHITPYTF | 1344 |
| 004S-H01 | Fzd4 | FTFSNYAMH | 215 | ALMSPDGTIIYYA | 456 | CAKGIVGDYGAFDIW | 717 | RASQSISSYLN | 1098 | AASSLQS | 1175 | CQQSYSTPLTF | 1372 |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 004S-B02 | Fzd4 | FTFSSYGMH | 230 | SSINNSSRTVFYA | 630 | CAKDHLAVADAHGR | 700 | RASQSISSYLN | 1098 | AASSLQS | 1175 | CQQSYSTPLTF | 1372 |
| 004S-E02 | Fzd4 | FTFSSYAMH | 227 | AVISYDGSNEYYA | 474 | CAGGEVYEL | 692 | RASQSISSYLN | 1098 | AASSLQS | 1175 | CQQSYSTPLTF | 1372 |
| 004S-F02 | Fzd4 | FTFSTYAMH | 242 | AVISSDGNNKYYT | 473 | CAAPDVVVTADGYYW | 685 | RASQGISSALA | 1076 | AASTLQS | 1179 | CQQANTVPFTF | 1322 |
| 004S-G02 | Fzd4 | FTFANYAMN | 190 | ALISYDGGTKYYA | 453 | CAKTLVTSHALHIW | 728 | RASQSISSYLN | 1098 | AASSLQS | 1175 | CQQSYSTPLTF | 1372 |
| 004S-H02 | Fzd4 | FTFANYAMH | 189 | ALISYDGGNKYYA | 452 | CAKTLVTSHALHIW | 728 | RASQSISSYLN | 1098 | AASSLQS | 1175 | CQQSYSTPLTF | 1372 |
| 001S-E03 | Fzd5 | GSFSGYYWH | 276 | GEINHSGSTNYN | 489 | CARGRRLVRFTVTSAFDIW | 858 | TGSSSNIGAGFGVH | 1158 | SDRNRPS | 1255 | CQSYDSSLRASVF | 1429 |
| 00-B05 | Fzd5 | GTFSSYAIS | 295 | GGIIPILGIANYA | 504 | CARIPKPRGYSYGDNGSW | 883 | RSSQSLLHSNGNTYLD | 1137 | LGSDRTS | 1234 | CMQSLQTPYTF | 1297 |
| 004S-A07 | Fzd6 | GNFKNYGIT | 271 | GRIIPALGTANYA | 525 | CARQYCSGGSCYPDAFDIR | 908 | RASQDIRSALA | 1063 | QASSLIS | 1245 | CQQYSMPQTF | 1361 |
| 004S-B07 | Fzd6 | FTFSSYSMN | 233 | GVISKDGDNKYYA | 553 | CASSRDGYNRLAFDIW | 965 | QASQDIRNYLN | 1043 | AASSLQS | 1175 | CQQSSRFWTF | 1347 |
| 004S-A08 | Fzd6 | GTFSSYAIS | 295 | GRIIPILGIANYA | 529 | CARDGGDYGMDVW | 767 | RASQSISSYLN | 1098 | AASSLQS | 1175 | CQQSYSTPLTF | 1372 |
| 004S-B08 | Fzd6 | YTFTNNFMH | 383 | PNSGGTNYA | 537 | CASQNYYGSGSYPGFDYW | 961 | RASQSISSYLN | 1098 | AASSLQS | 1175 | CQQSYSTPLTF | 1372 |
| 004S-D08 | Fzd6 | YTFTYRYLH | 394 | GGIIPIFGTANYA | 499 | CATHDSSGYYSFDYW | 973 | RASQSISSYLN | 1098 | AASSLQS | 1175 | CQQSYSTPLTF | 1372 |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 004S-E08 | Fzd6 | FSVSSNYM N | 187 | SAIGTGGGTYYA | 595 | CTTRTYDSSGYYETQNYYMDVW | 1024 | RSSRSLLHSNGNTYLQ | 1144 | LGSNRAS | 1237 | CVQTTQSPLTF | 1434 |
| 004S-G08 | Fzd6 | FTFSDYYMS | 208 | AAISYDESNKFYA | 423 | CARSAVAGAFDIW | 916 | RASQSISSYLN | 1098 | AASSLQS | 1175 | CQQSYSTPLTF | 1372 |
| 004S-A09 | Fzd6 | FTFRDYAM N | 198 | SGISWNSGSIGYA | 615 | CARRSGYSGSVYYYGMDVW | 913 | RASQSISSYLN | 1098 | AASSLQS | 1175 | CQQSYSTPLTF | 1372 |
| 004S-B09 | Fzd6 | FTFSSFGMH | 221 | AGINWNGGSVVYA | 441 | CARGPSHQHTFDIW | 854 | RASQGISSALA | 1076 | AASSLQS | 1175 | CQQSYSHTAFTF | 1357 |
| 004S-C09 | Fzd6 | YTFTNNFMH | 383 | GGFDPEDGETIYA | 492 | CARVGRGYSFDYW | 937 | RASQSISSYLN | 1098 | AASSLQS | 1175 | CQQSYSTPLTF | 1372 |
| 004S-E09 | Fzd6 | DTFSNYVIS | 163 | GRISAYNGYKSYA | 538 | CARSSGYVGWFDPW | 924 | RASQSISSYLN | 1098 | AASSLQS | 1175 | CQQSYSTPLTF | 1372 |
| 004S-F09 | Fzd6 | FTFSNYYTS | 218 | SYISGAGGSTEYA | 657 | CARLPRRSGKGSAFDIW | 888 | RASQSISSYLN | 1098 | AASSLQS | 1175 | CQQSYSTPLTF | 1372 |
| 004S-H09 | Fzd6 | GTFSSYTIS | 296 | NPNSGNTGYA | 583 | CARVGATSAGGMDVW | 935 | RASQSISSYLN | 1098 | AASSLQS | 1175 | CQQSYSTPLTF | 1372 |
| 004S-C10 | Fzd6 | YIFTDYYMH | 368 | GLVDPEDGETIYA | 520 | CAHSDFFSGLSFGDW | 693 | RASQSISSYLN | 1098 | AASSLQS | 1175 | CQQSYSTPLTF | 1372 |
| 004S-D10 | Fzd6 | FTFSNSDM N | 214 | SSISTSGGSTYYA | 637 | CARGSYW | 864 | RASQNINNYLA | 1081 | RASTLQS | 1249 | CQQYSSYPYTI | 1425 |
| 004S-E10 | Fzd6 | TTLNKYAIS | 365 | GRITPVVGVTNYA | 539 | CALSSSWYGGFDYW | 731 | RASQSISSYLN | 1098 | AASSLQS | 1175 | CQQSYSTPLTF | 1372 |
| 004S-F10 | Fzd6 | GFTFSDHY | 269 | ALVGYDGSQQFYG | 458 | CNTGIPMLYW | 1003 | RASQSISSYLN | 1098 | AASSLQS | 1175 | CQQSYSTPLTF | 1372 |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 004S-G10 | Fzd6 | FTFSDYYMS | 208 | SAISGSGFTYYA | 599 | CARVSRGFAFDYW | 948 | RASQSISSYLN | 1098 | AASSLQS | 1175 | CQQSYSTPLTF | 1372 |
| 004S-A11 | Fzd6 | GTFSSYAIS | 295 | GRIIPILGIANYA | 529 | CARESVNNYYYMDVW | 813 | RASQSISSYLN | 1098 | AASSLQS | 1175 | CQQSYSTPLTF | 1372 |
| 004S-C11 | Fzd6 | FTFSSYAMH | 227 | ALTSYDGSKKFYA | 457 | CAKTGRGYAFDIW | 726 | RASQSISSYLN | 1098 | AASSLQS | 1175 | CQQSYSTPLTF | 1372 |
| 004S-E11 | Fzd6 | FTFSSYNMN | 232 | KANGGTTDYA | 535 | CAKAGQQLDW | 696 | RASQSISSYLN | 1098 | AASSLQS | 1175 | CQQSYSTPLTF | 1372 |
| 004S-H11 | Fzd6 | FTFTSSAMQ | 249 | GGIIPIFGTANYA | 499 | CATVQTNYYDSSGRFSYRAHYFDYW | 977 | RASQSISRWLA | 1094 | AASSLQS | 1175 | CQQYVSYPLTF | 1426 |
| 004S-A12 | Fzd6 | YTFTNNFMH | 383 | GRINPNSGGTNYA | 537 | CARGQGYSSGWYRGDAFDIW | 855 | RASQSISSYLN | 1098 | AASSLQS | 1175 | CQQSYSTPLTF | 1372 |
| 004S-D12 | Fzd6 | FAFDDYAMH | 165 | KAYGGTTEYA | 490 | CAKDRGYSSGWYLDYW | 708 | RASQSISSYLN | 1098 | AASSLQS | 1175 | CQQSYSTPLTF | 1372 |
| 005S-H01 | Fzd7 | FNFSSYTMR | 173 | SVIYGGGNTNYA | 653 | CARGGSGGNLSYW | 836 | RASQSISSYLN | 1098 | AASSLQS | 1175 | CQQSYSTPLTF | 1372 |
| 005S-A02 | Fzd7 | GTFSSYAIS | 295 | GMIIPFLGITNYA | 521 | CTRPYDAFDIW | 1016 | RASQSISSYLN | 1098 | AASSLQS | 1175 | CQQSYSTPLTF | 1372 |
| 005S-C02 | Fzd8 | YTFASYGMH | 373 | GWINAGNGNTTYA | 558 | CARLSVWKWEQVTNWFDPW | 890 | RASQSISSYLN | 1098 | AASSLQS | 1175 | CQQSYSTPLTF | 1372 |
| 005S-E02 | Fzd8 | GTFTSYAIS | 305 | GWINAGNGNTKYS | 557 | CTTGLFPYYRYNWNNDAFDIW | 1022 | RASQSISSYLN | 1098 | AASSLQS | 1175 | CQQSYSTPLTF | 1372 |
| 005S-A03 | Fzd8 | GTFSSYAIS | 295 | GWMNPNSGNTGYA | 583 | CAKWHIGATGNWFDPW | 729 | RASQSISSYLN | 1098 | AASSLQS | 1175 | CQQSYSTPLTF | 1372 |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
| --- | --- | --- | --- | --- | --- | --- | --- | --- | --- | --- | --- | --- | --- |
| 005S-H03 | Fzd8 | YTFTNNFMH | 383 | GGIFPIYGISTYA | 494 | CARDRPTSWYAFDY | 792 | RASQGISNNLN | 1072 | DASTLQT | 1193 | CQQSFSAPITF | 1342 |
| 005S-F04 | Fzd8 | FSFSSTAMS | 181 | SYISSSGSITHYA | 670 | CARYGDYGDYW | 954 | RASQSISSYLN | 1098 | AASSLQS | 1175 | CQQSYSTPLTF | 1372 |
| 005S-H04 | Fzd8 | YTFTNNFMH | 383 | GWINAGNGNTTYA | 558 | CARVATGNAFDIW | 932 | RASQSISSYLN | 1098 | AASSLQS | 1175 | CQQSYSTPLTF | 1372 |
| 005S-B05 | Fzd8 | FTFSSYWMH | 239 | AGISGSGKTTFYA | 444 | CARGGLLFDYW | 831 | QASQDISNYLN | 1046 | KASSLES | 1226 | CQQSYSTPRTF | 1373 |
| 005S-F05 | Fzd8 | FTFTSSAVQ | 251 | GWMNPNSGNTGYA | 583 | CARRTAVAGTIDYW | 914 | RASQSISSYLN | 1098 | AASSLQS | 1175 | CQQSYSTPLTF | 1372 |
| 005S-G05 | Fzd8 | GTFSSYAIS | 295 | GWISPYNGNTNYA | 573 | CARGGWTNYGGNLDYW | 841 | RASQSISSYLN | 1098 | AASSLQS | 1175 | CQQSYSTPLTF | 1372 |
| 005S-H05 | Fzd8 | YTFTSYYMH | 392 | GRINPNSGGTNYA | 537 | CARVPDFWSGYLDYW | 943 | RASQGISRTLZ | 1075 | AASSLQS | 1175 | CQQTYSMPITF | 1392 |
| 005S-D06 | Fzd8 | YTFTYRYLH | 394 | GGIIPIFGTANYA | 499 | CARDSYPYGMDVW | 800 | RASQSISSYLN | 1098 | AASSLQS | 1175 | CQQSYSTPLTF | 1372 |
| 005S-F06 | Fzd8 | GTFSSYAIS | 295 | GRVIPILGVTNYA | 545 | CAREYLGSFDIW | 815 | RASQSVGSNLA | 1108 | GASSRAT | 1213 | CQQYGSSPPFTF | 1409 |
| 005S-A07 | Fzd9 | FTFTGSAVQ | 247 | GGILPIYGTTKYA | 509 | CARGARLYGFDYW | 822 | RASQSVSRNLA | 1114 | GASTRAT | 1217 | CQQRSNWPITF | 1335 |
| 005S-B07 | Fzd9 | FTFTSSAVQ | 251 | GWMNPNSGNTGYA | 583 | CARGRGQQWLTGYYGMDVW | 857 | RASQGISSALA | 1076 | GASTLQS | 1215 | CLQDYNYPFTF | 1272 |
| 005S-C07 | Fzd9 | FTFSSYSMN | 233 | SYIENDGSITTYA | 654 | CARAPYYYGSGSLFRLDYW | 748 | RASQSISSYLN | 1098 | AASSLQS | 1175 | CQQSYSTPLTF | 1372 |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 005S-D07 | Fzd9 | GTFNSYAIA | 291 | GGIIPIFGTANYA | 499 | CARAGSGYYNFDYW | 740 | RASQSINRWLA | 1090 | AASSLQS | 1175 | CQQTYNIPITF | 1388 |
| 005S-F07 | Fzd9 | FSFSSYGMH | 182 | AYINSRGSLMYYA | 483 | CAKTKLPIW | 727 | RASQSINRNYLG | 1089 | AASSRVT | 1176 | CQQYDSWPPTF | 1402 |
| 005S-G07 | Fzd9 | GSFSGYAIN | 274 | GGIIPIFGTANYA | 499 | CATGYYYDYYFDYW | 972 | RASQGISNNLN | 1072 | AASSLQS | 1175 | CQHYYNLPLTF | 1309 |
| 005S-H07 | Fzd9 | GTFTNNFMH | 303 | GLVDPEDGETIYA | 520 | CARTYRIVGATPRYYYYGMDVW | 931 | RASQTINNQLA | 1125 | KASNLET | 1224 | CQQANSFPVTF | 1318 |
| 005S-B08 | Fzd9 | YIFTDYYMH | 368 | GWINPNSGGTIYA | 562 | CARGPRDSGYYPGGAFDIW | 853 | RASQSISSYLN | 1098 | AASSLQS | 1175 | CQQSYSTPLTF | 1372 |
| 005S-D08 | Fzd9 | FAFSSHWMH | 166 | SAIDGSGGSTYYA | 592 | CARDRQLGWAHWYFDLW | 794 | RASQSISSYLN | 1098 | AASSLQS | 1175 | CQQSYSTPLTF | 1372 |
| 005S-G08 | Fzd9 | YTFTGYYMH | 379 | GWINAGNGNTTYA | 558 | CARDRDYW | 787 | QTSQDINNNLN | 1053 | KASSLES | 1226 | CQQSYSSPPTF | 1366 |
| 005S-C09 | Fzd9 | FTFSSYGMH | 230 | SAIGTGGGTYYA | 595 | CALLVGAARGISYYYYYGMDVW | 730 | QASQDISNYLN | 1046 | AASTLQS | 1179 | CLQHKSFPTF | 1276 |
| 005S-D09 | Fzd9 | YTFTSYAMH | 389 | GWINAGNGNTTYA | 558 | CARDRPYSSGWYYPAFDIW | 793 | RASQSVSSNQLA | 1117 | GASTRAT | 1217 | CQQRYNWPPSITF | 1339 |
| 005S-E09 | Fzd9 | FNLRRYNMN | 175 | SRISNSGSLVYYA | 627 | CARDADSSGYYRYDAFDIW | 762 | RASQSVSSNLA | 1116 | DASNRAT | 1188 | CQQRNNWLYTF | 1334 |
| 005S-A10 | Fzd9 | YTFTDYYMH | 376 | GIINPSGGSTSYA | 513 | CARHVYGSGTYNNWFDPW | 878 | RASQSISSYLN | 1098 | AASSLQS | 1175 | CQQSYSTPLTF | 1372 |
| 005S-D10 | Fzd9 | YTFTSYYMH | 392 | GWMSPNSANTGYA | 583 | CARGGPIHYYYYYYMDVW | 834 | RASQGISNNLN | 1072 | AASTLQS | 1179 | CQQTNLFPYTF | 1385 |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 005S-H10 | Fzd9 | GAFSTSSIS | 265 | GRIIPVLGTANYA | 534 | CAKGGWRSSFDPW | 715 | RASQSVSSNLA | 1116 | GASTRAT | 1217 | CQQYNSWPLTF | 1421 |
| 005S-B11 | Fzd9 | YTFTSYDIN | 390 | GGFDPEDGETIYA | 492 | CAKAGDWGLYGMDVW | 695 | RASQSISRWLA | 1094 | AASSLQS | 1175 | CQQTNTFPFTF | 1386 |
| 005S-C11 | Fzd9 | FTFTGSAVQ | 247 | GGILPIYGTTKYA | 509 | CARGARLYGFDYW | 822 | RASQSVSRKLA | 1113 | GASTRAT | 1217 | CQQRSNWPITF | 1335 |
| 005S-D11 | Fzd9 | YTFTNNFMH | 383 | GWINPNSGDTKFA | 561 | CAREANYDILTGYIRPDAFDIW | 806 | RASQSLRSKLA | 1106 | GASTRAT | 1217 | CQQYANSPWTF | 1401 |
| 005S-E11 | Fzd9 | GTFSSYAIS | 295 | GWINAGNGNTKYS | 557 | CTTTEYSSSPDYYYGMDVW | 1025 | QASQDISNYLN | 1046 | GASTLQS | 1215 | CQQLSRYPSLF | 1331 |
| 005S-G11 | Fzd9 | GTFTRNSIS | 304 | GGIIPIFGTANYA | 499 | CARSSDLRIFDYW | 922 | RASQSVSSNLA | 1116 | GASNRPT | 1209 | CQQYGSSPYTF | 1413 |
| 005S-H1 | Fzd10 | YTFASYDIH | 372 | GWINAGNGNTTYA | 558 | CARDGIWDIFDYW | 769 | RASQSISSYLN | 1098 | AASSLQS | 1175 | CQQSYSTPLTF | 1372 |
| 005S-E12 | Fzd10 | YIFTDYYMH | 368 | GVIFPVYPTPDYA | 551 | CARGGSTGYYGMDVW | 839 | RASQSVGRWMA | 1107 | AASSLQS | 1175 | CQQANTFPFTF | 1321 |
| 005S-F12 | Fzd10 | GTFSSYAIS | 295 | GRIVPIVDVVKYA | 541 | CARDTCSSTSCSPDYW | 801 | RASQSISSYLN | 1098 | AASSLQS | 1175 | CQQSYSTPLTF | 1372 |
| 006S-A01 | Fzd10 | FTFSSYSMN | 233 | SAIGTGGGTYYA | 595 | CAREGWFGESPFGMDVW | 810 | RASQSISSYLN | 1098 | AASSLQS | 1175 | CQQSYSTPLTF | 1372 |
| 006S-F01 | Fzd10 | YTFTRYAVH | 385 | GWISTFNDNTNYA | 576 | CASPTGMTTNFDYW | 959 | RASQSISSYLN | 1098 | AASSLQS | 1175 | CQQSYSTPLTF | 1372 |
| 006S-H01 | Fzd10 | YIFTDYYMH | 368 | GGIIPIFGTANYA | 499 | CAKGSYYYDSSGYYWDAFDIW | 723 | RASQGISNNLN | 1072 | AASNLET | 1166 | CQQTSSTPLTF | 1387 |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 006S-A02 | Fzd10 | YIFTDYYMH | 368 | GGIIPLFGTTDYA | 507 | CARDITGADGMDVW | 775 | RASQSISSYLN | 1098 | AASSLQS | 1175 | CQQSYSTPLTF | 1372 |
| 006S-D02 | Fzd10 | GTFSSYAIS | 295 | GRIIPTVGTANYA | 533 | CARDVCSGGSCSPDVW | 802 | RASQGISNNLN | 1072 | DASSLES | 1189 | CQQTYNTPRTF | 1390 |
| 006S-E02 | Fzd10 | FTFTSSATQ | 250 | GGIIPIFGTANYA | 499 | CARDGSSGWYSPNAFDIW | 770 | RASQGISNNLN | 1072 | AASSLQS | 1175 | CLQHNGYPITF | 1277 |
| 006S-H02 | Fzd10 | FTFRMYGMH | 200 | SRISPDGRTTTYA | 628 | CARSPRWYDAFDIW | 920 | RSSQSLLHSNGYNYLD | 1138 | RVSSRFS | 1251 | CMQGTHWPPTF | 1288 |
| 006S-A03 | Fzd10 | YIFTDYYMH | 368 | GWINAGNGNTTYA | 558 | CARDPIMFGDQPGWFDPW | 784 | RASESVSSNLA | 1055 | GASSRAT | 1213 | CQQYNKSPSF | 1419 |
| 006S-B03 | Fzd10 | GTFSSYAIS | 295 | GWINAGNGNTKYA | 556 | CAREGYDFWSGPYAFDIW | 811 | RASQTISRYLN | 1126 | EVSSLQG | 1203 | CQQSYSTPWTF | 1378 |
| 006S-C03 | Fzd10 | GTFSSNVIS | 293 | GGIIPIFGTANYA | 499 | CARGGYYYGMDVW | 843 | RASQSISSYLN | 1098 | AASSLQS | 1175 | CQQSYSTPLTF | 1372 |
| 014S-B01 | Fzd1 | YIFTDYYMH | 368 | GGIIPIFGTANYA | 499 | CARMSSDYYDSSGYYRRGMDVW | 895 | RASQGISNNLN | 1072 | GASTLQS | 1215 | CQQADSFPPTF | 1312 |
| 014S-D01 | Fzd4 | GTFSSYAIS | 295 | GWINAGNGNTTYA | 558 | CARHYYGSGSYPDW | 880 | RASQSISSHZN | 1096 | AASSLQS | 1175 | CQQSYSTPLTF | 1372 |
| 014S-E01 | Fzd4 | GTFSSYAIS | 295 | GWINAGNGNTTYA | 558 | CARHYYGSGSYPDW | 880 | RASQSIZZYZN | 1105 | AASSLQS | 1175 | CQQSYSTPLTF | 1372 |
| 014S-G01 | Fzd4 | GTFSSYAIS | 295 | GWMNPNNGNTTYA | 581 | CARHYYGSGNYRDW | 879 | RASQSISSYLN | 1098 | AASSLQS | 1175 | CQQSYSTPFTF | 1368 |
| 014S-A02 | Fzd4 | FTFSSNAMH | 223 | SGISGSGGSTYYA | 608 | CAKPGIAAAGTNNWFDPW | 725 | RASQGISSALA | 1076 | GASTVES | 1218 | CQQSYSTPRTF | 1373 |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 014S-B02 | Fzd4 | FTFSSYAMH | 227 | SGISGSGSSTYYA | 611 | CARPSTTSFGMDVW | 902 | RASQSVSSNLA | 1116 | GASTRAT | 1217 | CQQYDTPLRTF | 1403 |
| 014S-C02 | Fzd5 | YTFTSYYMH | 392 | PNSGGTNYA | 537 | CARVPDFWSGYLDYW | 943 | RASQGISSALA | 1076 | AASSLQS | 1175 | CQQTYSMPITF | 1392 |
| 014S-D02 | Fzd5 | GTFSTYAIS | 299 | GIINPSGGSTSYA | 513 | CARAKGSGWYVGSAFDIW | 744 | RASQSISSYLN | 1098 | AASSLQS | 1175 | CQQSYSTPLTF | 1372 |
| 014S-E02 | Fzd5 | FTFSDSYMS | 206 | GFIRSKAYGGTTEYA | 490 | CARATQELLLPYGMDVW | 758 | RASQSISSYLN | 1098 | AASSLQS | 1175 | CQQSYSTPLTF | 1372 |
| 014S-F02 | Fzd5 | YTFTSYYMH | 392 | GRINPNSGGTNYA | 537 | CARVPDFWSGYLDYW | 943 | RASQGVSTZLS | 1079 | AASSLQS | 1175 | CQQTYSMPITF | 1392 |
| 014S-G02 | Fzd6 | YTFTSYYMN | 392 | GIISPSGGSTSYA | 516 | CARWGDYGDLYYFDYW | 951 | RASQGISSALA | 1076 | ATSTLQS | 1183 | CQQVNSYPPTF | 1399 |
| 014S-H02 | Fzd6 | YIFTDYYMH | 368 | GRINPNSGGTNYA | 537 | CARARSSGWTDAFDIW | 751 | RASQSVSSWLA | 1120 | AASTLQT | 1180 | CQQSYSTPTF | 1376 |
| 014S-A03 | Fzd6 | GTFSSYAIS | 295 | GWINAGNGNTTYA | 558 | CARHYYGSGSYPDW | 880 | RASQSISSYLN | 1098 | AASSLQS | 1175 | CQQSYSTPLTF | 1372 |
| 014S-B03 | Fzd6 | FTFSSYNMN | 232 | GRIKSKANGGTTDTA | 535 | CARAGDSPDYW | 739 | RASQSISSYLN | 1098 | AASSLQS | 1175 | CQQSYSTPLTF | 1372 |
| 014S-E03 | Fzd8 | GTFSSYAIS | 295 | GWISPYNGYTKYA | 574 | CARAMWSYGQQNAFDIW | 745 | RASQSISSYLN | 1098 | AASSLQS | 1175 | CQQSYSTPLTF | 1372 |
| 014S-G03 | Fzd8 | FTFTSSAVQ | 251 | GWMNPNSGNTGYA | 583 | CARRTAVAGTIDYW | 914 | RASQSISSYLN | 1098 | AASSLQS | 1175 | CQQSYSTPLTF | 1372 |
| 014S-H03 | Fzd8 | YTFTSSAIH | 387 | GRINPNSGGTNYA | 537 | CARVKWELAIDYW | 940 | RASQSISSYLN | 1098 | AASSLQS | 1175 | CQQSYSTPLTF | 1372 |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 014S-B04 | Fzd8 | YIFTDYYMH | 368 | GWMNPNSGNTGYA | 583 | CARGGSRYDFWSGHWYFDLW | 837 | RASQGISNYLA | 1074 | AASSLQS | 1175 | CQQSYSTPFTF | 1368 |
| 014S-E04 | Fzd8 | YTFTGYYMH | 379 | GRINPNSGTNYA | 537 | CARDVPKLVTRGVAYGMDVW | 804 | RASQSISYLN | 1098 | AASSLQS | 1175 | CQQSYSTPLTF | 1372 |
| 014S-F04 | Fzd8 | YSFTTYGMN | 371 | GWINAGNGNTTYA | 558 | CARAAAGSYGGGYW | 736 | RASQGISNNLN | 1072 | EASSVAS | 1197 | CQQSYTSTPLNSF | 1381 |
| 014S-G04 | Fzd8 | FTFSSYGMS | 231 | SAISGSGGSTYYA | 600 | CARDLTPFTQQQLVLGLL | 780 | RASQSVSGYLA | 1112 | GASTRAA | 1216 | CQQYNYWPPAF | 1423 |
| 014S-H04 | Fzd8 | FTFTSSAVQ | 251 | GRIVPAIGFTQYA | 540 | CARSGYNRRGYFDYW | 919 | RASQSISYLN | 1098 | AASSLQS | 1175 | CQQSYSTPLTF | 1372 |
| 014S-A05 | Fzd8 | GTFSSYAIS | 295 | GGIIPIFGTANYA | 499 | CARVTLGASVDAFDIW | 949 | RASQGISNNLN | 1072 | DASSLES | 1189 | CLQHNSLPFTF | 1278 |
| 014S-B05 | Fzd8 | GTFSSYAIS | 295 | GWVSPNTGNTVYA | 587 | CTTDRRYSTYFDLW | 1021 | RASQSVSSNLA | 1116 | GVSNRAT | 1223 | CQQYNIWPRTF | 1418 |
| 014S-C05 | Fzd8 | YTFASYGMH | 373 | GWINAGNGNTTYA | 558 | CARLSVWKWEQVTNWFDPW | 890 | RASQSISYLN | 1098 | AASSLQS | 1175 | CQQSYSTPLTF | 1372 |
| 014S-D05 | Fzd8 | GTFTSYAIS | 305 | GWINAGNGNTKYS | 557 | CTTGLFPYYRYNWNNDAFDIW | 1022 | RASQSISYLN | 1098 | AASSLQS | 1175 | CQQSYSTPLTF | 1372 |
| 014S-F05 | Fzd9 | FTFTGSAVQ | 247 | GGILPIYGTTKYA | 509 | CARGARLYGCDYW | 821 | RASQZVSRZZA | 1127 | GASTRAT | 1217 | CQQRSNWPITF | 1335 |
| 014S-G05 | Fzd9 | FTFSSSWMH | 226 | SAIGTGGGTYYA | 595 | CARKVKGYCSGGSCYGYW | 884 | RVSQGISSALA | 1151 | AASSLQS | 1175 | CQQTFSVPWTF | 1384 |
| 014S-H05 | Fzd9 | FTFSNYAMT | 216 | STISGSGVSTFYA | 648 | CARHGRIAADIW | 876 | RASQSISYLN | 1098 | AASSLQS | 1175 | CQQSYSTPLTF | 1372 |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 014S-A06 | Fzd 9 | FTFZZSZVQ | 254 | GGILPIYGTTKYA | 509 | CARGARLYGFDYW | 822 | RASQSVSRNLA | 1114 | GASTRAT | 1217 | CQQRSNWPITF | 1335 |
| 014S-B06 | Fzd 9 | FTFSSYSMN | 233 | SYIENDGSITTYA | 654 | CARAPYYYGSGSLFRLDYW | 748 | RASQSISSYLN | 1098 | AASSLQS | 1175 | CQQSYSTPLTF | 1372 |
| 014S-C06 | Fzd 10 | FTFTGSAVQ | 247 | GGILPIYGTTKYA | 509 | CARGARLYGFDYW | 822 | RASQSVSRNLA | 1114 | GASTRAT | 1217 | CQQRSNWPITF | 1335 |
| 014S-D06 | Fzd 10 | FTFSRYAMH | 219 | SGIGVGGGTYYA | 605 | CARDAYNWFDPR | 763 | RASQSISRYLN | 1095 | AASSLQS | 1175 | CQQRYSTPLTF | 1340 |
| 014S-F06 | Fzd 10 | YIFTDYYMH | 368 | GVIFPVYPTPDYA | 551 | CARGGSTGYYGMDVW | 839 | RASQSVGRWMA | 1107 | AASSLQS | 1175 | CQQANTFPFTF | 1321 |
| 014S-G06 | Fzd 10 | FTFSSYAMH | 227 | SAIGAGGGTYYA | 593 | CARDAYNWFDPW | 764 | RASQSISSYLN | 1098 | AASSLQS | 1175 | CQQSYSTPLTF | 1372 |
| 014S-H06 | Fzd 10 | FTFSSYDMN | 229 | SAIGTGGGTYYA | 595 | CARDAYNWFDPW | 764 | RASQSISSYLN | 1098 | AASSLQS | 1175 | CQQSYSTPLTF | 1372 |
| 014S-A07 | Fzd 10 | FTFSNAQMS | 210 | SAIGTGGGTYYA | 595 | CAREGSYYDWYFDLW | 809 | RASQNIGSRLA | 1080 | GASNRAS | 1208 | CQQYNHWPPLFTF | 1417 |
| 017S-E08 | Fzd 8 | IIFSPNDMG | 313 | ALISSGGSTSYA | 450 | CHFGVASVGLNYW | 980 | | | | | | |
| 017S-H08 | Fzd 8 | RTFSSFVMG | 346 | AAVSASGGYTWYA | 432 | CNLAQRGETYW | 998 | | | | | | |
| 017S-A09 | Fzd 8 | LAFNGYTMG | 317 | AAISWSDNTYYA | 414 | CAAGFPTVFVVDGEYDYW | 680 | | | | | | |
| 017S-B09 | Fzd 8 | FTLDYYAIS | 255 | ADITSGGSTNYA | 437 | CNAVTYNGYTIW | 994 | | | | | | |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 017S-C09 | Fzd8 | LTFSDYTVG | 319 | ASSTGGGVFENYA | 464 | CNAVTYNGYTIW | 994 | | | | | | |
| 018S-D06 | Fzd4 | RIFSSYAQA | 330 | PRIPSDSTTFYA | 590 | CEVHNFGATYW | 979 | | | | | | |
| 018S-E06 | Fzd4 | RTFSNYVMG | 344 | AVISRSGGNTYYT | 472 | CNAVSTDWTTDYW | 992 | | | | | | |
| 018S-F06 | Fzd4 | RTFSTYGMG | 349 | AAISWSDNTYYA | 414 | CNSFPLRLHDW | 1002 | | | | | | |
| 018S-G06 | Fzd5 | LAIDDYYMV | 318 | SYISTSDGSTYYA | 673 | CNAVTYNGYSIW | 993 | | | | | | |
| 018S-H06 | Fzd5 | LAFNGYTMG | 317 | AQISWTGGSTDYA | 460 | CNADYGTWYGIGW | 985 | | | | | | |
| 0185-A07 | Fzd5 | LAFNGYTMG | 317 | AAISWMSNTYYA | 412 | CNMGLGYSEYRPLGYW | 999 | | | | | | |
| 018S-B07 | Fzd5 | SAFSNYAMG | 355 | AAITWSGARTYYA | 426 | CNAVWKFGTTHW | 995 | | | | | | |
| 018S-C07 | Fzd7 | LTIDDYYVV | 323 | SYISAGDGFTYYA | 656 | CNAVTYNGYTIW | 994 | | | | | | |
| 017S-F09 | Fzd4 | GSFSGYYWS | 277 | GEINHSGSTNYN | 489 | CARDLRFYSSSWRRVGMDVW | 778 | RSSRSLLHTSGYNYLD | 1147 | LGSNRAS | 1237 | CMQGTRWPTF | 1290 |
| 017S-G09 | Fzd4 | YTITTYAIH | 396 | GWINADTGDTAYS | 555 | CARGWTTISSLGVW | 872 | RSSRSLLHTNGYNYLD | 1146 | LGSNRAS | 1237 | CMQALQTPLTF | 1281 |
| 017S-H09 | Fzd5 | NIFRIYAIA | 326 | AALTGQRTTNYAASIT | 427 | CNTVTYNAGCYKKYW | 1004 | | | | | | |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 017S-A10 | Fzd5 | LAFNGYTMG | 317 | WNGRYTYYA | 462 | CNARLDAVYGHSRYDSW | 988 | | | | | | |
| 017S-B10 | Fzd5 | NFFSNYPLG | 325 | GAISRTGSGTFYA | 484 | CAAGVTGSWRYW | 684 | | | | | | |
| 017S-C10 | Fzd8 | RSFSNYRVA | 335 | AVSWSVGMTYYA | 479 | CNAVTYNGYTIW | 994 | | | | | | |
| 017S-D10 | Fzd8 | GTFGSYAVG | 288 | GLISRNAGNTLYA | 518 | CNAVNGRLNYW | 991 | | | | | | |
| 017S-E10 | Fzd8 | RTFSSYSLA | 348 | AAVSASGANTYYA | 431 | CAAPQSPNMYIRTDQLWWYKYW | 687 | | | | | | |
| 018S-D07 | Fzd1 | RSFSTYPMG | 336 | TVISGSGGSTYYA | 675 | CAAGPTLPFRYW | 683 | | | | | | |
| 018S-E07 | Fzd1 | RAFSNYAMG | 328 | AAINWSGDSAYYA | 406 | CNARLSFAGGMGYW | 989 | | | | | | |
| 018S-F07 | Fzd1 | IKSMFDMNFMG | 314 | AFITRGGTTRYG | 438 | CNAVSTDWTRDYW | 992 | | | | | | |
| 018S-G07 | Fzd1 | LTIDDYYMV | 322 | SYIGTSDGTTYYA | 655 | CNAVTYNGYTIW | 994 | | | | | | |
| 018S-H07 | Fzd4 | RVFSSYAQA | 354 | AGIASDSTTFYA | 439 | CKVHNFGATYW | 983 | | | | | | |
| 018S-A08 | Fzd4 | RIFSSYAQA | 330 | ASIPSDGTTFYA | 461 | CKVHNFEATYW | 982 | | | | | | |
| 018S-B08 | Fzd4 | LTFSTYGMG | 321 | AAINWSGRSTVYA | 407 | CNSFPLRLHDW | 1002 | | | | | | |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 018S-C08 | Fzd 4 | RTLSSYVVG | 351 | ALISLSGASTYYA | 449 | CNAVSTDWTTDYW | 992 | | | | | | |
| 018S-D08 | Fzd 5 | IKSMFDMNFMG | 314 | AFITRGGTTRYG | 438 | CNAVSTDWTRDYW | 992 | | | | | | |
| 018S-E08 | Fzd 5 | RTDGMQAMG | 338 | GAITWSLGSAFYA | 486 | CNVLAQNDGDYRTYG | 1007 | | | | | | |
| 018S-F08 | Fzd 5 | RTFSSFVMG | 346 | AAVSASGGYTWYA | 432 | CNAVWKFGTTHW | 995 | | | | | | |
| 018S-G08 | Fzd 5 | RTFSSFVMG | 346 | AAVSASGGYTWYA | 432 | CNAVCKFGTTHW | 990 | | | | | | |
| 018S-H08 | Fzd 5 | RTFSSFVMG | 346 | AAVTASGGYAWYA | 434 | CNAVWKFGTTHW | 995 | | | | | | |
| 018S-A09 | Fzd 8 | ITFSFNSVG | 316 | AVFIAGYGAYYA | 470 | CNGVTYNGYTIW | 997 | | | | | | |
| 018S-B09 | Fzd 8 | HDFSSTYGVG | 310 | ATISWGGTNIA | 468 | CAAQKPYYNGHFYADDKHYDHW | 688 | | | | | | |
| 018S-C09 | Fzd 8 | ITFGFDSVG | 315 | AVFNAGYRAYYA | 471 | CNAVTYNGYTIW | 994 | | | | | | |
| 018S-D09 | Fzd 8 | RTFSWYSMG | 350 | AAVSWSGVSTYYP | 433 | CNAVTYNGYTIW | 994 | | | | | | |
| 018S-E09 | Fzd 8 | ITFSFNSVG | 316 | AVFIAGYGAYYA | 470 | CIGVTYNGYTIG | 981 | | | | | | |
| 018S-F09 | Fzd 8 | RTDGMQAMG | 338 | GAITWSLGIAFYA | 485 | CNVLAQNDGDYRTYW | 1008 | | | | | | |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 018S-G09 | Fzd 8 | HDFSSTYGVG | 311 | AAISWRGTNIA | 413 | CAAQKPYYNGHFYADDKHYDHW | 688 | | | | | | |
| 021S-A01 | Fzd 8 | DSVSSNSAAWN | 160 | GRAYYKSRWYYDYA | 524 | CVRDLRPSGDLNFDYW | 1029 | RASQSIGSSLH | 1087 | YASQSVS | 1260 | CHQSGRVPVTF | 1268 |
| 021S-C01 | Fzd 1 | GSISSGGYSWS | 283 | GSIYHSGSTYYN | 547 | CARFYYDILNGYSYFDYW | 817 | RSSRSLLDTDDGNTYLD | 1142 | TLSHRAS | 1259 | CMQSIQLPWTF | 1295 |
| 021S-D01 | Fzd 1 | FTFSSYGMH | 230 | AVISYDGSNKYYA | 475 | CAKGSVFGLKAGGYADYW | 721 | RSSQSLVHSDGNTYLS | 1140 | KISNRFS | 1230 | CMQATQFPHTF | 1283 |
| 021S-E02 | Fzd 8 | YTFTSYGIS | 391 | GWISAYNGNTNYA | 570 | CARDGTPFYSGSYYGSW | 772 | QGDSLRTYYAS | 1052 | GKNNRPS | 1219 | CNSRDNSGKHKVF | 1300 |
| 021S-G02 | Fzd 8 | DSVSSNSGAWN | 162 | GRTYYRSKYYNGYA | 544 | PRLDYW | 1034 | RSSQSLLDSDDGNTYLD | 1133 | MLSSRAP | 1240 | CMQRLEFPYTF | 1294 |
| 021S-A03 | Fzd 8 | DSVSSNSAAWN | 160 | GRTYYRSKWYNDYA | 542 | CARSQATGERFDYW | 921 | RSSQNIFQSLN | 1131 | SASSLQS | 1254 | CQQSYNSPITF | 1349 |
| 022S-H06 | Fzd 4 | FTFSSYAMS | 228 | SVISTSGGTVLYT | 652 | CADGSGTSHR | 690 | RASQSISSYLN | 1098 | AASSLQS | 1175 | CQQSYSTPLTF | 1372 |
| 022S-A11 | Fzd 10 | YIFTDYYMH | 368 | GGIFPIFGTANYA | 493 | CAKGSYYYDNSGYYWDAFDIW | 722 | RASQGISNNIN | 1071 | AASNLET | 1166 | CQQTYSIPFTF | 1391 |
| OMP-18R5 | | GFTFSHYTLS | 270 | VISGDGSYTYYADSVKG | 677 | NFIKYVFAN | 1033 | SGDKLGKKYAS or SGDNIGSFYVH | 1152 or 1153 | EKDNRPSG or DKSNRPSG | 1200 or 1201 | SSFAGNSLE or QSYANTLSL | 1435 or 1436 |
| 027S-H02 | Fzd 5 | FTFSSYAMS | 228 | SAISGSGGSTYYA | 600 | CAKGLWGPLLNW | 718 | RASQSVSSNYLS | 1118 | GASSRAP | 1212 | CQQRTNWPPRVTF | 1337 |
| 027S-B03 | Fzd 8 | DSVSSNSATWN | 161 | GRTYYRSKWYSDYA | 543 | CTRGNWNVGLANW | 1014 | SGTSSNIGAGYDVH | 1157 | GNNNRPS | 1219 | CSAWDDNLNGVVF | 1432 |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 027S-E01 | Fzd5 | RSFSIYNTA | 334 | AAISWSGGSTYYA | 418 | CNVITIVRGMGPRAYW | 1006 | | | | | | |
| 004S-D05 | Fzd5 | LTFSIYAMH | 320 | SAISGDGALTYYA | 597 | CARGVYPYSSKHKPSYYYYGMDVW | 870 | QASQDISNYLN | 1046 | AASSLQS | 1175 | CQQSYSTPLFTF | 1371 |
| 004S-D04 | Fzd5 | YDFTTYGIH | 367 | GGVIPAFGATDYS | 511 | CARGYYYGMDVW | 874 | RASQSISSYLN | 1098 | AASSLQS | 1175 | CQQSYSTPLTF | 1372 |
| 004S-B05 | Fzd5 | GTFSSYAIS | 295 | GWINAGNGNTTYA | 558 | CASGLGYFDYW | 957 | RASQSISSYLN | 1098 | AASSLQS | 1175 | CQQSYSTPLTF | 1372 |
| 004S-G03 | Fzd5 | YTFTNNFMH | 383 | GGIIPIFGTPHYA | 502 | CARTLTTPPYYYGMDVW | 929 | RASQSISSYLN | 1098 | AASSLQS | 1175 | CQQSYSTPLTF | 1372 |
| 004S-F03 | Fzd5 | FTFSNSDMN | 214 | SAIGTGGDTYYA | 594 | CTRDLYGGYRDYW | 1013 | KSSQSLLHSDGYTYLY | 1036 | LGSNRAS | 1237 | CMQGLQTPWTF | 1286 |
| 004S-C04 | Fzd5 | YIFTGYYMH | 369 | GRINPNSGGTNYA | 537 | CARGGEYSSGWTYYYYGMDVW | 827 | RATQTISTYLN | 1129 | AASRLQS | 1171 | CQQYSYPWTS | 1427 |
| 004S-B06 | Fzd5 | YTFTYRYLH | 394 | GMINPIGGSINYA | 522 | CARDVMDVW | 803 | RASQGISNNLN | 1072 | AASALQS | 1165 | CQHLNNFPLTF | 1303 |
| 004S-F06 | Fzd5 | FSVGSNYMT | 186 | SSISSGNSYIYYA | 634 | CARGPKTMWEDRPDYW | 851 | RASQSISSYLN | 1098 | AASSLQS | 1175 | CQQSYSTPLTF | 1372 |
| 004S-A04 | Fzd5 | FTFSTYSMI | 245 | GFIRSKDYGGTTEYA | 491 | CARLTGGAVAGTHRDYW | 892 | RASQGISNNLN | 1072 | GASSLQS | 1211 | CQQSHSSPRTF | 1346 |
| 004S-A05 | Fzd5 | FTFSSYVMS | 237 | SAIGTGGGTYYA | 595 | CARGSSGYYVAW | 862 | RASQSISSYLN | 1098 | AASSLQS | 1175 | CQQSYSTPLTF | 1372 |
| 004S-F05 | Fzd5 | FTFSNHYMS | 212 | AGVSIDANKKYYA | 447 | CARDQNDSWYRSDYW | 785 | RSSQSLLHSDGYTYLY | 1135 | LGSHRAS | 1235 | CMQGLQTPHTF | 1285 |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 003S-C01 | Fzd1 | GTFSSYAIS | 295 | GRINPNSGGTNYA | 537 | CARGSGYDFFDYGMDVW | 861 | RASQSISNNLN | 1092 | AASSLQS | 1175 | CQQSYNTPFTF | 1350 |
| 003S-H01 | Fzd1 | DTFSNYVLS | 164 | GLVDPEDGETIYA | 520 | CAKASTPMVQGAPDYW | 697 | RASQSIGSNLD | 1085 | AASTLQS | 1179 | CQQNYATPRTF | 1333 |
| 003S-H02 | Fzd1 | GTFNRYAIT | 289 | GGIIPIFGTANYA | 499 | CATTQGVYSSSWYGGGRAFDIW | 976 | RASQSISSYLN | 1098 | AASSLQS | 1175 | CQQSYSTPLTF | 1372 |
| 003S-H04 | Fzd1 | YTFTYRYLH | 394 | GRINPNSGGTNYA | 537 | CWGGSYYGDYW | 1030 | RASQGISNNLN | 1072 | AASSLQS | 1175 | CQQANSFPITF | 1316 |
| 003S-A05 | Fzd2 | FTFSSYAMH | 227 | SSISWNSGRVDYA | 638 | CARGSGIAASGSYW | 860 | TSSQSLLHSDGKTYLY | 1162 | LGSNRAS | 1237 | CMQGTHWPYTF | 1289 |
| 003S-B05 | Fzd2 | FTFSNAWMS | 211 | STIAGSGGRTYYS | 643 | RGRGAPQPYYYYGMDVW | 709 | KSSQSLLHSDGKTYLY | 1036 | LGSNRAS | 1237 | CMQSLQSPLTF | 1296 |
| 003S-F05 | Fzd2 | FSFSTYTMS | 184 | SRINGDGSSTRYA | 624 | CARAIVGATGLNRFKAFDIW | 743 | KSSQSLLHSDGKTYLY | 1036 | LGSNRAS | 1237 | CMQNTHWPLTR | 1293 |
| 003S-G05 | Fzd2 | STFTNAWMS | 363 | SAIGTGGGTYYA | 595 | CARDRVTLRGGYSYGTDAFDIW | 796 | RSSRSLLHSNGNTYLR | 1145 | LASRRAS | 1231 | CIQNTHWPLTR | 1270 |
| 003S-H05 | Fzd2 | FTLSTYNMN | 257 | SRINYDGSATTYA | 626 | CARDRDIVVVPAQRGEGGFDPW | 786 | KSSQSLLHSDGKTYLY | 1036 | MGSYRAS | 1239 | CMQGTHWPLTF | 1287 |
| 003S-A07 | Fzd2 | FTFSSYAMS | 228 | SAISGSGGSTYYA | 600 | CAKGGRDGYKGYFDYW | 714 | KSSQSLLHSDGKTYLY | 1036 | LGSNRAS | 1237 | CMQNTHWPLTL | 1292 |
| 003S-C07 | Fzd2 | FSFRSYSMS | 178 | SAIGTGGGTYYA | 595 | CTTTTVTTSW | 1026 | RTSQSVSSNLA | 1150 | DASNRAS | 1187 | CQQYGSSPYNF | 1412 |
| 003S-F07 | Fzd2 | FSFSSYGMS | 183 | SHISSGGATIDYA | 619 | CARDGGYW | 768 | RASQSISSYLN | 1098 | AASSLQS | 1175 | CQQSYSTPLTF | 1372 |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 003S-G07 | Fzd2 | FTFSSYWMH | 239 | SYISGDSGYTNYA | 658 | CARDNGYCSGGSCYATYYGMDVR | 783 | RASQAISSYLA | 1060 | KASTLDT | 1228 | CQQADTFPFTF | 1313 |
| 003S-B08 | Fzd2 | FTFSSZZMH | 240 | AVISYDGSNRZYA | 476 | CARSYYDSSGYPRKDAFDIW | 927 | KSSQSLLHSDGKTYLY | 1036 | LGSNRAS | 1237 | CMQTLKAPLTF | 1299 |
| 003S-F08 | Fzd2 | ZSVSSNYMS | 401 | SRINSDGSTISYA | 625 | CARARLLGGYYTPDRMDVW | 750 | RSSQYLSSAYLA | 1141 | GASSRAT | 1213 | CQQYGSSPTF | 1411 |
| 003S-H08 | Fzd2 | FTFNRHALS | 197 | ALISSNGDHKYYT | 451 | CARDLMVGRNKLDYW | 777 | QASQGISNNLN | 1049 | AASSLQS | 1175 | CQQSYSTPAFTF | 1367 |
| 003S-A09 | Fzd2 | FTFSSSNMN | 225 | SGISGSGSSTYYA | 611 | CARGRVWSSRDYW | 859 | RSSQSLLHSDGTYLY | 1135 | LGSNRAS | 1237 | CMQGTHWPLTF | 1287 |
| 003S-B09 | Fzd2 | FNIRRZNMZ | 174 | SAIGTGGGTYYA | 595 | CARGDSGSYRDYW | 823 | RSSESLLHSDGKTYLY | 1130 | LGSNRAS | 1237 | CTQTVQFPITF | 1433 |
| 003S-C09 | Fzd2 | FTFSSSAMH | 224 | SGISGSGTTTYYR | 612 | CARRLIAVAGAEFDPW | 612 | RASQGISNNLN | 912 | SASNLQS | 1252 | CQQSYSTPWTF | 1378 |
| 003S-F09 | Fzd4 | FTFSNSDMN | 214 | KAYGGTTEYA | 536 | CARQYYFDYW | 909 | RASQSISSYLN | 1098 | AASSLQS | 1175 | CQQSYSTPLTF | 1372 |
| 003S-H09 | Fzd4 | FTFSSFGMH | 221 | SVISSGGSPYYA | 651 | CATASGDFDYW | 968 | RASQSIGSNLN | 1086 | RASTLES | 1248 | CQQTYTTPRF | 1398 |
| 003S-A10 | Fzd4 | FTFDDYAMH | 191 | AIVSYDGTYKYYS | 448 | CARQTRGGTTDGW | 907 | RASQGISNNLN | 1072 | YASSLQS | 1262 | CQQSHSPPGTF | 1345 |
| 003S-B10 | Fzd4 | FTFSSHSTH | 222 | SAISASGDSTFYA | 596 | CARPIVGATAFDIW | 900 | RASQSISSYLN | 1098 | AASSLQTF | 1175 | CQQSYSTPL | 1372 |
| 003S-G10 | Fzd4 | FTZSSYSMN | 264 | SYSSGNSGYTNYA | 674 | CARGVVGSGAFDIW | 868 | RASQSIVSYLN | 1104 | DASNLQS | 1186 | CQQGYSAPWTF | 1329 |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 003S-B11 | Fzd4 | FTFSDYYMS | 208 | SAIDGAGRTYYT | 591 | CARAIPGDYDYW | 742 | RASQSISSYLN | 1098 | AASSLQS | 1175 | CQQSYSTPLTF | 1372 |
| 003S-C11 | Fzd4 | FTFTSYAMH | 252 | GGIIPIFGIANYA | 496 | CARTGRGYYGMDVW | 928 | RASQSIGSNLD | 1085 | AASTLQS | 1179 | CQQSYSTPRTF | 1373 |
| 003S-D11 | Fzd4 | FTFSSYSMS | 234 | SYISGDSGYTNYA | 658 | CARAGVATIAFDYW | 741 | RASQSISSYLN | 1098 | AASSLQS | 1175 | CQQSYSTPLTF | 1372 |
| 003S-F11 | Fzd4 | FTFDDYGMH | 192 | SAISGSGGSTYYA | 600 | CTTPNYYDSR | 1023 | RASQSISSYLN | 1098 | AASSLQS | 1175 | CQQSYSTPLTF | 1372 |
| 003S-E12 | Fzd4 | GTFSSYAIS | 295 | GWINAGNGNTTYA | 558 | CARHYYGSGSYPDW | 880 | ZPZQTZZSHLN | 1164 | PASSLQS | 1242 | CQQSYSTPLTF | 1372 |
| 004S-A01 | Fzd4 | FTFSTYGMH | 244 | SYISSSSSAIYYA | 671 | CARGGLDGPIDYR | 830 | RASQGISNNLN | 1072 | AASTLQS | 1179 | CQQGNNFPFTF | 1326 |
| 004S-G01 | Fzd4 | FTVSSHSMG | 260 | SLVSFDGSKEHYA | 621 | CARLGSTPDYW | 887 | RASQGISNNLN | 1072 | AASSLQS | 1175 | CQQYYTYPYTF | 1428 |
| 004S-C02 | Fzd4 | FTFSSYGMH | 230 | AVISYDGSNKYYA | 475 | CASDPVTAATR | 956 | RASQSISSYLN | 1098 | AASSLQS | 1175 | CQQSYSTPLTF | 1372 |
| 004S-D02 | Fzd4 | FSFSSYGMS | 183 | SGISGSGRSTYYA | 610 | CAKDGYW | 699 | RASQSISSYLN | 1098 | AASSLQS | 1175 | CQQSYSTPLTF | 1372 |
| 004S-A03 | Fzd4 | FTFSSYAMH | 227 | WNGGSTGYA | 606 | CARPAGSAQNWFDPW | 899 | RASQGISNNLN | 1072 | DASNLET | 1185 | CHQSYSIPRTF | 1269 |
| 004S-B03 | Fzd4 | FSFSRYGMS | 180 | SGVGGSGGSTZYA | 617 | CARDGSW | 771 | RASQDVDTWLA | 1066 | DASTLET | 1191 | CQQGYNIPWTF | 1328 |
| 004S-C03 | Fzd4 | YTFTSYAIS | 388 | GIINPSGGSTSYA | 513 | CARQIGWELMPDIW | 906 | QASQDISSYLN | 1047 | AASTLQS | 1179 | CQQAISFPLTF | 1315 |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 004S-C05 | Fzd5 | ZZZTDYYZQ | | GGMNZNRGNTGYA | 403 | CANGSYAQHLW | 510 | RASQSISSYLN | 732 | AASSLQS | 1098 | CQQSYSTPLTF | 1175 | 1372 |
| 004S-G05 | Fzd5 | FTFSSYWMH | 239 | STISPSGLYIYQA | 649 | CAKDKVPYSYGPNFDYW | 703 | RASQSISSYLN | 1098 | AASSLQS | 1175 | CQQSYSTPLTF | 1372 |
| 004S-E06 | Fzd5 | FFFSGYWMS | 169 | QDGSEKYYV | 459 | CARVFPLHDYW | 934 | QASQDISNYLN | 1046 | KASSLES | 1226 | CQQANSFPYTF | 1319 |
| 004S-C06 | Fzd5 | FPFSTFSMN | 176 | AGISWNSGTIDYA | 446 | CARSGPAAMVYYYGMDVW | 918 | RSSQNVSSYLA | 1132 | GASTRAT | 1217 | CQHRANWPQTF | 1305 |
| 004S-E07 | Fzd6 | FTLSSHHMN | 256 | SAIGTGGGTYYA | 595 | CAAPDYW | 686 | RASQSISSYLN | 1098 | AASSLQS | 1175 | CQQSYSTPLTF | 1372 |
| 004S-F07 | Fzd6 | FSFSKKYMT | 179 | SSIDGNGDHVFYA | 629 | CARPYYYDSSGYDPMGDYW | 904 | QASQDITNYLN | 1048 | KASTLES | 1229 | CQQSYSAPYTF | 1356 |
| 004S-C08 | Fzd6 | FTVSSNYM | 261 | SAIGTGGGTYYA | 595 | CAQGTYW | 735 | RASQSISSYLN | 1098 | AASSLQS | 1175 | CQQSYSTPLTF | 1372 |
| 004S-F08 | Fzd6 | FTFDDYYMN | 193 | SAVSGNGGGTFYA | 604 | CARGGNYGSGDYW | 833 | RASQSISZWLA | 1102 | EASTLQS | 1198 | CQQTYTPPFTF | 1397 |
| 004S-G09 | Fzd6 | GTLNNHTLS | 308 | GRIIPIFGTANYA | 526 | CARDRRGYGMDVW | 795 | RASQAISNSLA | 1058 | DASNLET | 1185 | CQQAYSFPWTF | 1324 |
| 004S-B10 | Fzd6 | FTFSDYYMS | 208 | SGINWNSAKIGYV | 607 | CARIGAGGAFDIW | 881 | RASQSISSYLN | 1098 | AASSLQS | 1175 | CQQSYSTPLTF | 1372 |
| 004S-H10 | Fzd6 | FIFSDYYMS | 170 | AVITSGGTFKYYA | 477 | CARNGIAAAEDYW | 896 | RASQSISTYLS | 1101 | GASSLES | 1210 | CQQSYSPPFTF | 1362 |
| 004S-B11 | Fzd6 | FTFSSSWMH | 226 | SGISWNSGSIGYA | 615 | CARYSSGGSLDYW | 955 | RASQSISSYLN | 1098 | AASSLQS | 1175 | CQQSYSTPLTF | 1372 |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 004S-D11 | Fzd6 | YZFZZYMH | 400 | GRINPNSGGTNYA | 537 | CARARSSGWTDAFDIW | 751 | RASQSVSSWLA | 1120 | AASTLQT | 1180 | CQQSYSTPTF | 1376 |
| 004S-F11 | Fzd6 | FTFSSYAMS | 228 | SSISGGGRHTYYA | 632 | CARPYSSSRQGDYW | 903 | RASQSISSYLN | 1098 | AASSLQS | 1175 | CQQSYSTPLTF | 1372 |
| 004S-G11 | Fzd6 | YIFTDYYMH | 368 | GWINPNSGGTNYA | 564 | CARDRPGFDPW | 790 | RASQSVSSYLA | 1121 | GASSRAT | 1213 | CQQYAISYTF | 1400 |
| 004S-B12 | Fzd6 | FTFSSYWIH | 238 | SYISGDSGYTNYAGWM | 658 | CAKGIRWFDPW | 716 | RASQSISSYLN | 1098 | AASSLQS | 1175 | CQQSYSTPLTF | 1372 |
| 004S-C12 | Fzd6 | YIFTDYYMH | 368 | NPNSGNTGYA | 583 | CASSHYAPGMDVW | 962 | RASQGISSYLA | 1076 | RTSTLES | 1250 | CQQYSTPWTF | 1378 |
| 004S-F12 | Fzd7 | FTVGNNYMS | 258 | SSITTTSTLYA | 640 | CARGKEGRYSNYEAAW | 844 | RASQSISSYLN | 1098 | AASTLQT | 1180 | CQQSYSIPFTF | 1358 |
| 005S-B01 | Fzd7 | FTFRSYGMH | 202 | SLISGSGDNTNYA | 620 | CARREPLYSSRRGAFDIW | 910 | RASQSISSYLN | 1098 | AASSLQS | 1175 | CQQSYSTPLTF | 1372 |
| 005S-C01 | Fzd7 | FTFSSYSMS | 234 | SAISGSGGSTYYA | 600 | CTRTIVGATPHYW | 1017 | RASQGISNNLN | 1072 | KASSLQS | 1227 | CQQSYSLPYTF | 1360 |
| 005S-F01 | Fzd7 | FTVSSNYMS | 262 | SAISGSGATTTYA | 598 | CAKGAGYGSGSWQAAW | 711 | RASQSVSSSYLS | 1119 | GASSRAT | 1213 | CQQRYKSYTF | 1338 |
| 005S-B02 | Fzd8 | YSFTNYAMH | 370 | GRIIPIFGTAZYA | 527 | CARGTFLEWLLTNYGMDVW | 866 | RASQSISSYLN | 1098 | AASSLQS | 1175 | CQQSYSTPLTF | 1372 |
| 005S-D02 | Fzd8 | GTFSSYVIS | 297 | GWIGPHNGNTNYA | 554 | CATGWPRYYYGMDVW | 971 | RASQSVSSNLA | 1116 | NTSNRAT | 1241 | CQHYNNWPFTF | 1308 |
| 005S-G02 | Fzd8 | YTFTSYYMH | 392 | GGIIPIFGTAZYA | 500 | CARLPYYDFWSGYYGRTGFDYW | 889 | RASQSVSTNLA | 1122 | DASNRAT | 1188 | CQQRSNWPPQITF | 1336 |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 005S-H02 | Fzd8 | YTFTYRYLH | 394 | GWINAGNGNTTYA | 558 | CARASLYYDYVWGSYRHYYFDYW | 753 | QASQDISHYLN | 1044 | AASSLQS | 1175 | CQQSYSTPLTF | 1372 |
| 005S-B03 | Fzd8 | GTFSSYAIS | 295 | GIINPSGGRTTYA | 512 | CATSFGGGWIVVDTSLWYW | 975 | RASQSINSNLA | 1091 | GASSRAT | 1213 | CQQYGSSPYTF | 1413 |
| 005S-C03 | Fzd8 | GSFSGYAIS | 275 | GGIIPIFGTANYA | 499 | CRVDAFDIW | 1009 | RASQSVSSSYLS | 1119 | DTSNRAT | 1194 | CQQYGSSPITF | 1408 |
| 005S-E03 | Fzd8 | FTFTSSAVQNYA | 251 | GGIIPIFGTAW | 499 | CARSSGWQNRFAFDI | 923 | RTSQSISSYLNS | 1149 | AASTSQ | 1181 | CQQSFSSWTF | 1343 |
| 005S-F03 | Fzd8 | YTFTYRYLH | 394 | GWINAGNGNTKYS | 557 | CATDLPVRKGFTYYDILTGSYGMDVW | 970 | RASQSISSYLN | 1098 | AASSLQS | 1175 | CQQSYSTPLTF | 1372 |
| 005S-B04 | Fzd8 | YTFTNNFMH | 383 | GGIIPIFGTANHA | 498 | CARGLRYFDWPQGIYYYYGMDVW | 848 | QASHDINIALN | 1039 | AASSLQS | 1175 | CQQSYSSPLTF | 1365 |
| 005S-C04 | Fzd8 | YTFTSYYMH | 392 | GRINPNSGGTNYA | 537 | CARGGLLFDYW | 831 | RASQSISSYLN | 1098 | AASSLQS | 1175 | CQQSYSTPLTF | 1372 |
| 005S-D04 | Fzd8 | FTFSTYSMS | 246 | STIGTGGGTYYA | 645 | CARVGWLRFLDYW | 938 | RASQSISSYLN | 1098 | AASSLQS | 1175 | CQQSYSTPLTF | 1372 |
| 005S-G04 | Fzd8 | GTFSSYAIS | 295 | GWMSPSSGNAGYA | 585 | CARNNFLRAFDIW | 897 | RASQSISSYLN | 1098 | AASSLQS | 1175 | CQQSYSTPLTF | 1372 |
| 005S-A05 | Fzd8 | FAFSSYAMS | 167 | SRIDTDGSTTYVA | 622 | CARAPSYSSGWYVRW | 747 | RASQSISSYLN | 1098 | AASSLQS | 1175 | CQQSYSTPLTF | 1372 |
| 005S-C05 | Fzd8 | YTFTYYAMH | 395 | GIINPSGGSTSYA | 513 | CARELLPMTTVTSPFIW | 812 | RASQGISNNLN | 1072 | RASSLQS | 1247 | CQQANSYPLTF | 1320 |
| 005S-E05 | Fzd8 | GTFSSYAIS | 295 | GGIIPIFGTANYA | 499 | CAIRAFDIW | 694 | RASQSISSYLN | 1098 | AASSLQS | 1175 | CQQSYSTPLTF | 1372 |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 005S-C06 | Fzd8 | ZTFSZYDMH | 402 | SSISSSSHYKYYA | 635 | CARVRSKAVAGTLPKRLFDIW | 947 | RASQSVSSSYLS | 1119 | AASRRAT | 1172 | CQQYSNWPFTF | 1424 |
| 005S-E06 | Fzd8 | YTFTSYYMH | 392 | GWMNPNSGNTGYA | 583 | CARGNPTSGHIVVVPAATFSDYW | 850 | QASQDISNRLN | 1045 | SASRLQI | 1253 | CQQSYRTPRTF | 1354 |
| 005S-G06 | Fzd8 | GTFSZZTIS | 302 | GWMNPDSGKTGYA | 579 | CARWAFPIPNAFDIW | 950 | RASQSISSYLN | 1098 | AASSLQS | 1175 | CQQSYSTPLTF | 1372 |
| 005S-H06 | Fzd8 | YTFTNNFMH | 383 | GGIFPIYGISTYA | 494 | CARDRPSSSWYAFDYW | 791 | RASQGISNNLN | 1072 | DASTLQT | 1193 | CQQSFSAPITF | 1342 |
| 005S-A08 | Fzd9 | GTFSZYAIS | 301 | GGIIPIFGTANYA | 499 | CARGGLLRFGDGWGMGMDVW | 832 | RASQSISKSLA | 1097 | GASTRAT | 1217 | CQQYGIAPTF | 1407 |
| 005S-C08 | Fzd9 | YTFTDYHMH | 375 | GWINAGNGNTTYA | 558 | CARASSWYLHYYYGMDVW | 755 | RASQSISSYLN | 1098 | AASSLQS | 1175 | CQQSYSTPLTF | 1372 |
| 005S-E08 | Fzd9 | FIFSZYAMS | 171 | SSISAAGAYKYYA | 631 | CARRGYSSGWRDAFDIW | 911 | RASQSISSYLN | 1098 | AASSLQS | 1175 | CQQSYSTPLTF | 1372 |
| 005S-F08 | Fzd9 | YTFTSYYMH | 392 | GWINAGNGNTTYA | 558 | CAKDVNYW | 710 | QASQGISNYLN | 1050 | AASSLQS | 1175 | CQQTYSTPTTF | 1395 |
| 005S-H08 | Fzd9 | GTFSSYAIS | 295 | GRIIPILGTPNYA | 531 | CARDRLAFDYW | 789 | RASQSISSYLN | 1098 | AASSLQS | 1175 | CQQSYSTPLTF | 1372 |
| 005S-A09 | Fzd9 | FAFSSHWMH | 166 | SAISVSGGTFYA | 602 | CARWGKRLRGSPYYFDYW | 952 | RASQSIGSNLD | 1085 | RASTLQS | 1249 | CQQSYSTPSF | 1375 |
| 005S-F09 | Fzd9 | FTFSIYGMH | 209 | SGISWNSGNIGYA | 614 | CARGPLPTKIGGHYMDVW | 852 | RASQSISSYLN | 1098 | AASSLQS | 1175 | CQQSYSTPLTF | 1372 |
| 005S-B10 | Fzd9 | FTFSTXWMS | 241 | AVMYSGGTTYYA | 478 | CARLSYYYDSSGPKGDAFDIW | 891 | RASQGISNNLN | 1072 | AASSLQS | 1175 | CQQGNNFPLTF | 1327 |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 005S-C10 | Fzd9 | FSLSSYGMH | 185 | SSISSSSSYIYYA | 636 | CARSGMVKWLRSFDYW | 917 | RASQDIGSFLA | 1061 | AASSLQS | 1175 | CQKYNRAPFTF | 1310 |
| 005S-E10 | Fzd9 | FTFTSSAMQ | 249 | GVINPGSGGTSYN | 552 | CARGYGDYVWGENYFDYW | 873 | RASQSISSYLN | 1098 | AASSLQS | 1175 | CQQSYSTPLTF | 1372 |
| 005S-F10 | Fzd9 | YTLSNYGIS | 397 | GWISAYNGDTKYA | 568 | CARFDYFGGMDVW | 816 | RASQSISSYLN | 1098 | AASSLQS | 1175 | CQQSYSTPLTF | 1372 |
| 005S-G10 | Fzd9 | YTFTRYAVH | 385 | GGIIPFFNTVNYA | 495 | CAADRSPYYYDSSGYYPDAFDIW | 679 | RASQGISNNLN | 1072 | QASSLDS | 1244 | CQQSYNVPYTF | 1352 |
| 005S-A11 | Fzd9 | FTFSSYDMN | 229 | SGISWNSGYIGYA | 615 | CAKGSLLLGYYGMDVW | 720 | RASQSISNNLN | 1092 | DASTLKR | 1192 | CQQSYNTPRTF | 1350 |
| 005S-B12 | Fzd10 | FTZSSYDMH | 263 | SSISGLGGSTYZA | 633 | CAREAGTTGGWFDPW | 805 | RASQSISSYLN | 1098 | AASSLQS | 1175 | CQQSYSTPLTF | 1372 |
| 005S-D12 | Fzd10 | FTFSDHYMD | 204 | STIGPAGDTYYP | 644 | CARASTSGDYSLW | 756 | RASQSVSTSYLA | 1123 | GASTRAT | 1217 | CQQYGASPWTF | 1406 |
| 006S-B01 | Fzd10 | YTFTNYCTR | 384 | GLVCPSDGSTSYA | 519 | CARRTSASDIW | 915 | RASQSISSYLN | 1098 | AASSLQS | 1175 | CQQSYSTPLTF | 1372 |
| 006S-C01 | Fzd10 | FTFTZSAVQ | 253 | GGFDPEDGETIYA | 492 | CTTDPLELPWYW | 1020 | RASQGISSALA | 1076 | SASNLQS | 1252 | CQQAISFPLTF | 1315 |
| 006S-E01 | Fzd10 | YTFTGYYMH | 379 | GIINPSSGRTDYA | 514 | CARDLTYYYDSSGHSPLGAFDIW | 781 | RASQSVTSSLA | 1124 | GASTRAT | 1217 | CQQYNDWPPTF | 1416 |
| 006S-G01 | Fzd10 | FTFSDFGMN | 203 | AGISGGGSTDYA | 443 | CARDSDFWYYYGMDVW | 797 | KSSQSVLYSSNNKNYLA | 1037 | STNTRSS | 1257 | CQHRNFF | 1306 |
| 006S-B02 | Fzd10 | VSFSGYAMH | 366 | AYINSGSSEMNYA | 482 | CAREEWELFGMDVW | 807 | RASQSISSYLN | 1098 | AASSLQS | 1175 | CQQSYSTPLTF | 1372 |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 006S-G02 | Fzd10 | YTVTSYAMH | 399 | GGIIPIFGTAKYA | 497 | CAKGGQWLYGMDVW | 713 | RASQSISSYLN | 1098 | AASSLQS | 1175 | CQQSYSTPLTF | 1372 |
| 014S-A01 | Fzd1 | YTFTSYYMH | 392 | GWVSPSSGNTAYA | 588 | CARDEGAGYYYYMDVW | 766 | RASQSISSYLN | 1098 | AASSLQS | 1175 | CQQSYSTPLTF | 1372 |
| 014S-C01 | Fzd2 | FTFSNYAMT | 216 | SAIGTGGGTYYA | 595 | CATAYRRPGGLDVW | 969 | RSSQSLLHSDGKTYLY | 1134 | LGSNRAS | 1237 | CMQNTHWPLTR | 1293 |
| 014S-F01 | Fzd4 | FTFSSYAMH | 227 | SVISTSGDTVLYT | 652 | CARGGSSDVR | 838 | RASQSISSYLN | 1098 | AASSLQS | 1175 | CQQSYSTPLTF | 1372 |
| 014S-H01 | Fzd4 | FTFSNYGMH | 217 | SYISSSSSTIYYA | 672 | CARAALGYCTGGVCPPVDYW | 737 | RASQGISNNLN | 1072 | AASRLQS | 1171 | CQQSYSPPLTF | 1363 |
| 014S-C03 | Fzd7 | YTFTNNFMH | 383 | GIIZPGGGRTIYA | 517 | CAKGDYGALDYW | 712 | RASQSISSYLN | 1098 | AASSLQS | 1175 | CQQSYSTPLTF | 1372 |
| 014S-D03 | Fzd7 | FNFSSYTMR | 173 | SVIYGGGNTNYA | 653 | CARGGSGGNLSYW | 836 | RASQSISSYLN | 1098 | AASSLQS | 1175 | CQQSYSTPLTF | 1372 |
| 014S-F03 | Fzd8 | YTFTNNFMH | 383 | GGIIPLFGTANYA | 506 | CARLVVRGGYGMDVW | 893 | RASQSISSYLN | 1098 | AASSLQS | 1175 | CQQSYSTPLTF | 1372 |
| 014S-A04 | Fzd8 | GTFSSYAIS | 295 | GWISSFNGNTKYA | 575 | CARADDYYDSSGYYYGFDYW | 738 | RASQSISSYLN | 1098 | AASSLQS | 1175 | CQQSYSTPLTF | 1372 |
| 014S-C04 | Fzd8 | FTFSSYTMN | 235 | SRINGDGSNTNYA | 623 | CARGWAGFDYW | 871 | RASQSISSYLN | 1098 | AASSLQS | 1175 | CQQSYSTPLTF | 1372 |
| 014S-D04 | Fzd8 | HTFSGYHIH | 312 | GWINAGNGNTTYA | 558 | CARDLSPMVRGVISGMDVW | 779 | RASQSISSYLN | 1098 | AASSLQS | 1175 | CQQSYSTPLTF | 1372 |
| 014S-E05 | Fzd8 | YTFTNNFMH | 383 | GIISPGGGRTIYA | 515 | CAKGDYGALDYW | 712 | RASQSISSYLN | 1098 | AASSLQS | 1175 | CQQSYSTPLTF | 1372 |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 014S-E06 | Fzd10 | FTFGNYDMN | 195 | SSLSWNSGTIVYA | 641 | CARDSSSGWYASYYGMDVW | 798 | RASQSISRYLN | 1095 | AASSLQS | 1175 | CLQHHSYPFTF | 1275 |
| 027S-C02 | Fzd5 | YTLTTWYMX | 398 | GWMNPNSGNTAYA | 582 | CARGALGMDVW | 819 | QASQDISNYLN | 1046 | AASSLHT | 1173 | CQESYSSPYTF | 1302 |
| 027S-E03 | Fzd8 | YTFTGHYMH | 378 | GWMNPNSGNTGTA | 583 | CARGTGGFDYW | 867 | RASQSISSYLN | 1098 | AASSLQS | 1175 | CQQSYSTPYTF | 1379 |
| 027S-F03 | Fzd8 | YTFTGHYIH | 377 | GWMNPISGNTGYA | 580 | CARSTPFDPW | 925 | RASHDIGTFLA | 1057 | AASTLQS | 1179 | CQQSYRTPYTF | 1355 |
| 027S-G03 | Fzd8 | YTFTHSYIH | 380 | GWINAKSGGTFYA | 559 | CARGDYDFWSGYHEYYYYGMDVW | 824 | QATQNIKKYLN | 1051 | KASTLES | 1229 | CQQSYSTPLTF | 1372 |
| 027S-H03 | Fzd8 | YTFTSYYMH | 392 | GWINPNSGGTNYA | 564 | CARAPLDGSGSYYVDW | 746 | RSSQSLLHSNGYNYLD | 1138 | LGSNRAS | 1237 | CMQALQTPQTF | 1282 |
| 027S-A04 | Fzd8 | YTFTNHFMH | 382 | GWISPNRGGTNYA | 571 | CARDCSGGSCYSHFDYW | 765 | RASQSISRSLA | 1093 | AASNLQS | 1169 | CQQAYSFPQTF | 1323 |
| 027S-B04 | Fzd8 | FTVGSWYMS | 259 | SAIGTGGGTYYA | 595 | CAKDITPYGDYSILSHW | 702 | RASQAISNYLN | 1059 | AASSLQS | 1175 | CQQTFSPPLTF | 1383 |
| 027S-C04 | Fzd8 | YTFTSHWMH | 386 | GGIIPIFGTTNYA | 503 | CARDSSSWYSYYYYMDVW | 799 | RASQGINNYLA | 1067 | QASNLES | 1243 | CQQTYSSPLTF | 1393 |
| 027S-D04 | Fzd8 | YTFTTYFMH | 393 | GWIYPNSGGTKYA | 578 | CTTDLRYDSSGPAAFDIW | 1019 | QASQDIDNYLN | 1040 | AASSLQS | 1175 | CQQSYSTPVTF | 1377 |
| 027S-E04 | Fzd8 | FTFSDHYMS | 205 | SGISGSGGTTYYA | 609 | CATYGDFGYFDLW | 978 | RASQGIRNDLG | 1069 | AASTLQS | 1179 | CQQAYSFPWTF | 1324 |
| 027S-C05 | Fzd8 | GSFSTSVFG | 279 | GRIIPLFGTTNYA | 532 | CVKDRAWGFDYW | 1027 | RASQGIRNDLA | 1068 | AASSLQR | 1174 | CQQSYSKPTF | 1359 |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 027S-D05 | Fzd8 | YTFTSYYMH | 392 | GWINPKSGGTNYA | 560 | CARGGFVFDYW | 828 | QASQDISNYLN | 1046 | ASSTLQT | 1182 | CQQSYSAPYTF | 1356 |
| 027S-E05 | Fzd8 | GTFSSYAIS | 295 | GMINPSGGSTTYA | 523 | CARQAGLHCSSTSCYLGNWFDPW | 905 | RASQGITKSLA | 1077 | AASNLQL | 1168 | CQQYNTFPITF | 1422 |
| 027S-F05 | Fzd8 | GTFNRYGIS | 290 | GGIIPRLGATDYA | 508 | CAKGNWAFDIW | 719 | RASQSISTYLA | 1100 | GASTRAT | 1217 | CQQYGSSPTF | 1411 |
| 027S-G05 | Fzd8 | GTFSSYAIS | 295 | GWISPYNGNTKYA | 572 | CARGVWTTPMGGGGNWFDPW | 869 | RASQSISSYLN | 1098 | YASSLQN | 1261 | CQQSYSTPFTF | 1368 |
| 027S-H05 | Fzd8 | GTFGNYGIN | 286 | GWINPNSGGTNYA | 564 | CARETTDYYYGMDVW | 814 | RASQSIGTYLN | 1088 | DASNLET | 1185 | CQQANSFPLTF | 1317 |
| 027S-A06 | Fzd8 | GTFSSYAIN | 294 | GVIDPSTGGTNYA | 550 | CARVLPGDSSGWYRGYYYYYGMDVW | 941 | RASQGISNNLN | 1072 | KASSLES | 1226 | CQQANSFPITF | 1316 |
| 027S-C06 | Fzd8 | GTFTSYPIS | 306 | GWINTYNGNTIYA | 566 | CARDLDSGFDLW | 776 | RASQGVGDYLA | 1078 | DASNLQS | 1186 | CQQHNAYPLTF | 1330 |
| 027S-D06 | Fzd8 | GTFSSYAIS | 295 | GWISAYNGHTNYA | 569 | CARGGYSYGTVFDYW | 842 | RASQDISSWLA | 1064 | KASTLES | 1229 | CQQSYGAPLTF | 1348 |
| 027S-E06 | Fzd8 | YTFTKDYMH | 381 | GGIIPIFGTANYA | 499 | CARGLPPAAGGGGYFQHW | 847 | RASQNVNDWLA | 1082 | SASNLQS | 1252 | CQQSYSTPFTF | 1368 |
| 027S-F06 | Fzd8 | FTFSSYAMH | 227 | AVTWYDGSNKYYA | 480 | CAKDLVPYCSGGSCPPSGW | 705 | RASQSISSYLN | 1098 | GASNLQS | 1207 | CQQSYSTPLTF | 1372 |
| 027S-G06 | Fzd5 | YTFTDYYMHFA | 376 | GWMSPNSGNAG | 584 | CARGKSGSFDYW | 846 | RASQVNNTYVAT | 1111 | GTSTRATF | 1222 | CQQYDTSPP | 1404 |
| 027S-H06 | Fzd5 | YTFTGHYIH | 377 | GIINPSGGSTSYA | 513 | CARGFCSGGSCLWYGMDVW | 825 | RASQSISSYLN | 1098 | AASSLQS | 1175 | CQQSYTTPFTF | 1382 |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 027S-A07 | Fzd 5 | GTFGSYAIT | 287 | GGIIPIFGTANYA | 499 | CAKDNGWYFDLW | 706 | RASQSISTNVN | 1099 | AASSLQS | 1175 | CQQSYSTPYTF | 1379 |
| 029S-B01 | Fzd 1 | GTFSSYAIS | 295 | GRINPHNGNTNYA | 1461 | CARATRVSAAGTVHFQHW | 1472 | KSSQSVLHSSNNKNYLA | 1498 | STNTRS | 1257 | CQQYYSTPFTF | 1544 |
| 029S-D01 | Fzd 2 | YTFTRYYIH | 1452 | GWMNPNSGNTGYA | 583 | CARVRFLEEMDVW | 1494 | RASQSLSSWLA | 1512 | DASTLQS | 1520 | CQQAISFPLTF | 1315 |
| 029S-C02 | Fzd 2 | GTFSSYGIS | 1457 | GIINPSGGSTSYA | 513 | CARGDIVATMGMKKVDYYYYMDVW | 1478 | RASQDISNNLN | 1500 | GASHLQT | 1522 | CQQANSFPVTF | 1318 |
| 029S-F02 | Fzd 2 | YTFTRYYLH | 1453 | GWMNPNSGNTGYA | 583 | CARGIGYW | 1481 | RASQGISNYLA | 1074 | AASRLQT | 1515 | CLQYNTYPWTF | 1528 |
| 029S-H02 | Fzd 2 | GTFSTYAIS | 298 | GDIIPIFGSANYA | 1458 | CARELGLGWFDPW | 1476 | RSSQSLLHSNGYNYLD | 1138 | LGSSRAS | 1525 | CMQALQTPLTF | 1281 |
| 030S-A02 | Fzd 7 | YTFTDYYMH | 1449 | GWMNPNSGSTGYA | 1467 | CARGDINYGNFDYW | 1477 | RASQSISYLN | 1098 | KASTLHN | 1523 | CQQAISFPLTF | 1315 |
| 030S-B02 | Fzd 3 | YTFTDYYMH | 1449 | GWMNPNSGNTGYA | 583 | CARQGGSYSMGLDPW | 1488 | RASQSITYLN | 1511 | KTSSLQS | 1524 | CQQGDSFPYTF | 1531 |
| 029S-E03 | Fzd 3 | YTFTGYYMH | 379 | GWINPNSGNTGYA | 1463 | CARSYYGVIDAFDIW | 1492 | RASQSISYLN | 1098 | AASSLQT | 1516 | CQQSFRLPLTF | 1532 |
| 029S-G03 | Fzd 3 | YTFTNYYMH | 1451 | GWMNPNSGNTGYA | 583 | CAREDDFWSGGGMDVW | 1474 | RASQSIISYLN | 1509 | AASSLQS | 1175 | CQQSWRFPYTF | 1535 |
| 030S-E03 | Fzd 3 | PTFSDYYMS | 1438 | SAISGSGHSTYYA | 1468 | CAREGLRGWSIFDIW | 1475 | KSSQSVLYSSNNKNYLA | 1037 | WASTRES | 1526 | CQQYYSTPPTF | 1545 |
| 029S-D05 | Fzd 3 | YTFTDHYFH | 1447 | GWANPSSGNTGTA | 1462 | CARSRLRWDWYFDLW | 1491 | RASQTISYLN | 1513 | DASNLET | 1185 | CQQSYSIPLTF | 1536 |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 030S-H03 | Fzd 3 | FSFSSHAMS | 1437 | SAIGTGGGTYYA | 595 | CANPKHYW | 1470 | RASGVSTYLA | 1505 | AASSLQS | 1175 | CQQYYSSPQTF | 1543 |
| 029S-B06 | Fzd 3 | YTFSRHYIH | 1446 | GWMNPNSGNTGYA | 583 | CARGGHTNHW | 1479 | RASQSVSGYSSGWYSWLA | 1120 | AASSLQS | 1175 | CQQAFRFPPTF | 1529 |
| 029S-E06 | Fzd 3 | YWFTASYMH | 1455 | GWMKPDSGNTGYA | 1465 | CARRSSSWGWYFDLW | 1489 | RASQNINSWLA | 1506 | AASSLQS | 1175 | CQQYYSFPLTF | 1542 |
| 29S-H06 | Fzd 3 | YTFAKYYIH | 1444 | GWMNPNSGNTGYA | 583 | CARHKRHTPYAFDIW | 1487 | RASQSISYLN | 1098 | AASSLQS | 1175 | CQQSHSTPLTF | 1533 |
| 029S-G07 | Fzd 3 | YTFTDSYIH | 1448 | GWISAYNGNTNYA | 570 | CARGSGYFDLW | 1486 | RASQSISKWLA | 1510 | GASTLQS | 1215 | CQQAYSFPWTF | 1324 |
| 029S-H08 | Fzd 3 | YTFTGHYMH | 378 | GWMNPNSGNTGYA | 583 | CARVGDYDRFNWYFDLW | 1493 | RASRTVYNFLA | 1514 | DASNLRT | 1519 | CQQSYSTPPTF | 1537 |
| 029S-F09 | Fzd 3 | GTFSSYAIT | 1456 | GWISAYNGNTNYA | 570 | CARANRGLRKNYYYGMDVW | 1471 | RASQSIARYLN | 1507 | GASSLQS | 1211 | CQQSYNTPWTF | 1351 |
| 030S-F04 | Fzd 3 | YTFTSSYIH | 1454 | GIINPSGGAVYA | 1459 | CARWTTVVTGAAFDIW | 1495 | RASQGIRNDLN | 1502 | DASNLGT | 1518 | CQQSSRIPPTF | 1534 |
| 029S-A10 | Fzd 3 | YSFTGYYLH | 1442 | GWINPNSGGTNYA | 564 | CARDHGTMIAVAGTFDYYYMDVW | 1473 | RASQGISKYLA | 1503 | AASSLQS | 1175 | CQQSYSTPWTF | 1538 |
| 029S-B11 | Fzd 3 | YTFNGYYMH | 1445 | GIVNPSGGGTNYA | 1460 | CARGGNYGRWLQPWYFDLW | 1480 | QASQDISNYLN | 1046 | GASALRS | 1521 | CQQTKSFPLTF | 1540 |
| 029S-D11 | Fzd 3 | HTFTSHYMH | 1440 | GWMNPNSANAGYA | 1466 | CARGLGYFDLW | 1483 | RASQDISRGLG | 1501 | AASTLYR | 1517 | CQQAYSFPWTF | 1324 |
| 030S-H05 | Fzd 7 | YSFTNYYMH | 1443 | GWMNPNSGNTGYA | 583 | CARSPDFWSGEGYFDLW | 1490 | RASQSIGNYLN | 1508 | AASSLQS | 1175 | CQQANSFPLTF | 1530 |

TABLE 1A-continued

Anti-Fzd Antibody Clone IDs and CDR sequences

| Clone ID | Initial Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 030S-A06 | Fzd7 | YMFTGHDMH | 1441 | GRIIPILGIANYA | 529 | CARGIHGDYGLDYYYMDVW | 1482 | RASQAIGRRLA | 1499 | AASSLQS | 1175 | CQQYDTYWTF | 1541 |
| 029S-C12 | Fzd7 | YTFTGYYMH | 379 | GWMNPNSGNTGYA | 583 | CARGMEYW | 1484 | RASQGISSYLA | 1076 | AASTLQS | 1179 | CLQYNTYPWTF | 1528 |
| 030S-C06 | Fzd7 | YTFTGYYIH | 1450 | GWMDPNSGYTGYA | 1464 | CARGPADFWSGYKNDYFDFW | 1485 | RASQGISSWLA | 1504 | DASSLQS | 1190 | CQQSYSTPYSF | 1539 |
| 4A12 | Fzd5 | GYTFTNYDIN | 1439 | WIYPRDGSTKYNEKFKG | 1469 | CVRSAWGFAY | 1496 | KASQDVGTAVA | 1497 | WASTRHT | 1527 | QQYSTYPLT | 1546 |

TABLE 1B

Anti-Fzd Antibody Clone IDs, Heavy Chain (HC) and Light Chain (LC) Seq ID Nos, and Binding Characteristics

| Clone ID | HC SID NO | LC SID NO | Confirmed Binding |
|---|---|---|---|
| 001S-B01 | 1 | 38 | Fzd1, 2, 7, 9 |
| 001S-E02 | 2 | 39 | Fzd1, 2, 7 |
| 001S-G02 | 3 | 40 | Fzd1, 2, 7 |
| 001S-H02 | 4 | 41 | Fzd1, 2, 7 |
| 001S-A03 | 5 | 42 | Fzd1, 2, 7, 9 |
| 001S-B03 | 6 | 43 | Fzd1, 2, 7 |
| 004S-G06 | 7 | 44 | Fzd5, 8 |
| 002S-B01 | 8 | | Fzd1 |
| 002S-C02 | 9 | | Fzd1 |
| 002S-E02 | 10 | | Fzd1 |
| 002S-G02 | 11 | | Fzd1 |
| 002S-F03 | 12 | | Fzd1 |
| 002S-A04 | 13 | | Fzd1 |
| 002S-B04 | 14 | | Fzd1 |
| 002S-D04 | 15 | | Fzd1 |
| 004S-H04 | 16 | 45 | Fzd5 |
| 001S-A04 | 17 | 46 | Fzd1, 2, 5, 7, 8 |
| 003S-E07 | 18 | 47 | Fzd2 |
| 003S-D10 | 19 | 48 | Fzd4 |
| 004S-B08 | 20 | 49 | Fzd6 |
| 004S-D08 | 21 | 50 | Fzd6 |
| 004S-C09 | 22 | 51 | Fzd6 |
| 004S-F10 | 23 | 52 | Fzd6 |
| 004S-A11 | 24 | 53 | Fzd6 |
| 004S-A12 | 25 | 54 | Fzd6 |
| 005S-B07 | 26 | 55 | Fzd9 |
| 005S-D08 | 27 | 56 | Fzd9 |
| 005S-E09 | 28 | 57 | Fzd9 |
| 005S-H10 | 29 | 58 | Fzd9 |
| 005S-B11 | 30 | 59 | Fzd9 |
| 005S-D11 | 31 | 60 | Fzd9 |
| 014S-G02 | 32 | 61 | Fzd6 |
| 014S-B04 | 33 | 62 | Fzd8 |
| 014S-B06 | 34 | 63 | Fzd9 |
| 014S-G06 | 35 | 64 | Fzd10 |
| 014S-A07 | 36 | 65 | Fzd10 |
| 017S-B09 | 37 | | Fzd8 |
| 004S-D01 | 129 | 130 | Fzd4 |
| 004S-E09 | 131 | 132 | Fzd6 |
| 004S-F09 | | | Fzd6 |
| 004S-H09 | | | Fzd6 |
| 004S-B10 | | | Fzd6 |
| 004S-C10 | | | Fzd6 |
| 004S-F10 | | | Fzd6 |
| 004S-G10 | | | Fzd6 |
| 004S-A11 | | | Fzd6 |
| 004S-B11 | | | n.b. |
| 004S-D11 | | | Fzd6 |
| 004S-E11 | | | n.b. |
| 004S-F11 | | | Fzd6 |
| 004S-G11 | | | Fzd6 |
| 004S-A12 | | | Fzd6 |
| 004S-B12 | | | Fzd6 |
| 004S-C12 | | | n.b. |
| 004S-D12 | | | n.b. |
| 004S-F12 | | | n.b. |
| 004S-G12 | | | n.b. |
| 005S-B02 | | | n.b. |
| 005S-C02 | | | n.b. |
| 005S-D02 | | | Fzd5, 8 |
| 005S-E02 | | | Fzd5, 8 |
| 005S-H02 | | | Fzd5, 8 |
| 005S-A03 | | | Fzd5, 8 |
| 005S-C03 | | | n.s. |
| 005S-E03 | | | n.s. |
| 005S-F03 | | | Fzd8 |
| 005S-B04 | | | Fzd5, 8 |
| 005S-F04 | | | n.b. |
| 005S-G04 | | | Fzd5, 8 |
| 005S-H04 | | | n.b. |
| 005S-E05 | | | n.b. |
| 005S-G05 | | | Fzd5, 8 |
| 005S-H05 | | | Fzd5, 8 |
| 005S-D06 | | | Fzd8 |
| 005S-F06 | | | n.b. |
| 005S-G06 | | | n.b. |
| 005S-A07 | | | Fzd9, 10 |
| 005S-B07 | | | Fzd9 |
| 005S-A08 | | | Fzd9 |

TABLE 1B-continued

Anti-Fzd Antibody Clone IDs, Heavy Chain (HC) and Light Chain (LC) Seq ID Nos, and Binding Characteristics

| Clone ID | HC SID NO | LC SID NO | Confirmed Binding |
|---|---|---|---|
| 005S-B08 | | | Fzd9 |
| 005S-D08 | | | Fzd9 |
| 005S-E08 | | | Fzd9 |
| 005S-F08 | | | n.b. |
| 005S-C09 | | | Fzd9 |
| 005S-D09 | | | Fzd9 |
| 005S-E09 | | | Fzd9 |
| 005S-F09 | | | Fzd9 |
| 005S-A10 | | | Fzd9 |
| 005S-B10 | | | Fzd9 |
| 005S-E10 | | | Fzd9 |
| 005S-H10 | | | Fzd9 |
| 005S-B11 | | | Fzd9 |
| 005S-D11 | | | Fzd9 |
| 005S-G11 | | | n.b. |
| 005S-H11 | | | n.b. |
| 005S-E12 | | | Fzd10 |
| 006S-A01 | | | Fzd10 |
| 006S-H01 | | | n.b. |
| 006S-A02 | | | Fzd10 |
| 006S-D02 | | | n.b. |
| 006S-H02 | | | Fzd10 |
| 006S-A03 | | | n.b. |
| 006S-B03 | | | n.b. |
| 006S-C03 | | | n.b. |
| 014S-A01 | | | Fzd1, 2, 7 |
| 014S-B02 | | | n.b. |
| 014S-G02 | | | Fzd6 |
| 014S-B03 | | | n.b. |
| 014S-C03 | | | Fzd1, 2, 7 |
| 014S-A04 | | | n.b. |
| 014S-B04 | | | Fzd8 |
| 014S-B05 | | | Fzd5, 8 |
| 014S-B06 | | | Fzd9 |
| 014S-F06 | | | n.s. |
| 014S-G06 | | | Fzd10 |
| 014S-A07 | | | Fzd10 |
| 017S-E08 | | | Fzd8 |
| 017S-H08 | | | n.b. |
| 017S-A09 | | | n.b. |
| 017S-B09 | | | Fzd8 |
| 018S-F06 | | | Fzd4 |
| 018S-H06 | | | n.b. |
| 018S-B07 | | | n.b. |
| 017S-A10 | | | n.b. |
| 017S-B10 | | | n.b. |
| 017S-D10 | | | n.b. |
| 018S-H08 | | | n.b. |
| 018S-B09 | | | Fzd5, 8 |
| 021S-A01 | | | n.b. |
| 021S-E02 | | | Fzd5, 8 |
| 021S-G02 | | | n.s. |
| 021S-A03 | | | n.b. |
| 029S-B01 | | | n.b. |
| 029S-D01 | | | Fzd1, 2, 7 |
| 029S-C02 | | | Fzd1, 2, 7 |
| 029S-H02 | | | Fzd1 |
| 030S-A02 | | | Fzd7 |
| 029S-E06 | | | Fzd2, 6, 3 |
| 030S-F04 | | | Fzd3 |
| 030S-H05 | | | Fzd7 |
| 030S-A06 | | | Fzd1, 2, 7, 5 |
| 029S-C12 | | | Fzd7 |
| 030S-C06 | | | Fzd1 |
| 001S-A01 | | | Fzd1, 2, 7 |
| 001S-H01 | | | Fzd1, 2, 7 |

In certain embodiment, the Fzd binding domain may be selected from any binding domain that binds a Fzd with an affinity of, e.g., a $K_D$ of at least about $1 \times 10^{-4}$ M, at least about $1 \times 10^{-5}$ M, at least about $1 \times 10^{-6}$ M, at least about $1 \times 10^{-7}$ M, at least about $1 \times 10^{-8}$ M, at least about $1 \times 10^{-9}$ M, or at least about $1 \times 10^{-10}$ M. In certain embodiment, the Fzd binding domain may be selected from any binding domain that binds one or more Fzd receptor at high affinity, e.g., a $K_D$ of less than about $1 \times 10^{-7}$ M, less than about $1 \times 10^{-8}$ M, less than about $1 \times 10^{-9}$ M, or less than about $1 \times 10^{-10}$ M. In certain embodiment, the Fzd binding domain may be selected from any binding domain that binds Fzd at high affinity, e.g. a $K_D$ of less than or equal to about $1 \times 10^{-4}$ M, less than or equal to about $1 \times 10^{-5}$ M, less than or equal to about $1 \times 10^{-6}$ M, less than or equal to about $1 \times 10^{-7}$ M, less than or equal to about $1 \times 10^{-8}$ M, less than or equal to about $1 \times 10^{-9}$ M, or at least about $1 \times 10^{-10}$ M in the context of a Wnt surrogate molecule.

Suitable Fzd binding domains include, without limitation, de novo designed Fzd binding proteins, antibody derived binding proteins, e.g. scFv, Fab, etc. and other portions of antibodies that specifically bind to one or more Fzd proteins; VHH or single domain antibody derived binding domains; knottin-based engineered scaffolds; norrin and engineered binding fragments derived therefrom, naturally occurring Fzd binding domains, and the like. A Fzd binding domain may be affinity selected to enhance binding to a desired Fzd protein or plurality of Fzd proteins, e.g. to provide tissue selectivity.

In some embodiments, the Fzd binding domain binds to one, two, three, four, five or more different frizzled proteins, e.g. one or more of human frizzled proteins Fzd1, Fzd2, Fzd3, Fzd4, Fzd5, Fzd6, Fzd7, Fzd8, Fzd9, Fzd10. In some embodiments, the Fzd binding domain binds to Fzd1, Fzd2, and Fzd 7. In some embodiments, the Fzd binding domain binds to Fzd1, Fzd2, Fzd5, Fzd7 and Fzd8. In other embodiments the Fzd binding domain is selective for one or more frizzled protein of interest, e.g. having a specificity for the one or more desired frizzled protein of at least 10-fold, 25-fold, 50-fold, 100-fold, 200-fold or more relative to other frizzled proteins.

In certain embodiments, the Fzd binding domain comprises the six CDR regions of the pan specific frizzled antibody OMP-18R5 (vantictumab). In certain embodiments, the Fzd binding domain is an scFv comprising the six CDR regions of the pan-specific frizzled antibody OMP-18R5 (vantictumab). See, for example, U.S. Pat. No. 8,507,442, herein specifically incorporated by reference. For example, the CDR sequences of OMP-18R5 include a heavy chain CDR1 comprising GFTFSHYTLS (SEQ ID NO:270), a heavy chain CDR2 comprising VISGDGSYTYY-ADSVKG (SEQ ID NO:677), and a heavy chain CDR3 comprising NFIKYVFAN (SEQ ID NO:1033), and (ii) a light chain CDR1 comprising SGDKLGKKYAS (SEQ ID NO:1152) or SGDNIGSFYVH (SEQ ID NO:1153), a light chain CDR2 comprising EKDNRPSG (SEQ ID NO:1200) or DKSNRPSG (SEQ ID NO:1201), and a light chain CDR3 comprising SSFAGNSLE (SEQ ID NO:1435) or QSY-ANTLSL (SEQ ID NO:1436). In particular embodiments, the Fzd binding domain is an antibody or derivative thereof, including without limitation scFv, minibodies, VHH or single domain antibodies (sdAb) and various antibody mimetics comprising any of these CDR sequences. In certain embodiments, these CDR sequences comprise one or more amino acid modifications.

In other embodiments, the Fzd binding domain comprises a variable region sequence, or the CDRs thereof, from any of a number of frizzled specific antibodies, which are known in the art and are commercially available, or can be generated de novo. Any of the frizzled polypeptides can be used as an immunogen or in screening assays to develop an antibody. Non-limiting examples of frizzled binding domains include antibodies available from Biolegend, e.g. Clone CH3A4A7 specific for human frizzled 4 (CD344);

Clone W3C4E11 specific for human Fzd9 (CD349); antibodies available from Abcam, e.g. ab64636 specific for Fzd7; ab83042 specific for human Fzd4; ab77379 specific for human Fzd7; ab75235 specific for human Fzd8; ab102956 specific for human Fzd9; and the like. Other examples of suitable antibodies are described in, inter alia, US Patent application 20140105917; US Patent application 20130230521; US Patent application 20080267955; US Patent application 20080038272; US Patent application 20030044409; etc., each herein specifically incorporated by reference.

The Fzd binding region of a Wnt surrogate molecule may be an engineered protein that is selected for structural homology to the frizzled binding region of a wnt protein. Such proteins can be identified by screening a structure database for homologies. The initial protein thus identified, for example the microbial Bh1478 protein. The native protein is then engineered to provide amino acid substitutions that increase affinity, and may further be selected by affinity maturation for increased affinity and selectivity in binding to the desired frizzled protein. Non-limiting examples of frizzled binding moieties include the Fz27 and Fz27-B12 proteins.

In particular embodiments, a Wnt surrogate molecule comprises an LRP5/6 binding domain, e.g., an anti-LRP5/6 antibody, or antigen-binding fragment thereof, fused to a polypeptide that specifically binds to one or more Fzd receptors. In particular embodiments, the polypeptide that specifically binds to LRP5/6 is an antibody or antigen-binding fragment thereof. If certain embodiments, it is an antibody or antigen-binding fragment thereof disclosed in the U.S. provisional patent application No. 62/607,879, titled, "Anti-LR5/6 Antibodies and Methods of Use," filed on Dec. 19, 2017, which is incorporated herein by reference in its entirety. In particular embodiments, the LRP5/6 binding domain comprises the three heavy chain CDRs and/or the three light chain CDRs disclosed for any of the illustrative antibodies or fragments thereof that bind to LRP5 and/or LRP6 provided in Table 2A. In particular embodiments, the LRP5/6 binding domain comprises the three heavy chain CDRs and/or the three light chain CDRs disclosed for any of the illustrative antibodies or fragments thereof that bind to one or more Fzd receptor provided in Table 2A, wherein the CDRs collectively comprise one, two, three, four, five, six, seven, or eight amino acid modifications, e.g., substitutions, deletions, or additions. In certain embodiments, the LRP5/6 binding domain is a VHH or sdAb or was derived from a VHH or sdAb, so Table 2A only includes the three heavy chain CDRs. In certain embodiments, the LRP5/6 biding domain comprises the three heavy chain CDRs shown in Table 2A or variants wherein the CDRs collectively comprise one, two, three, four, five, six, seven or eight amino acid modifications. In particular embodiments, the LRP5/6 binding domain comprises the heavy chain fragment and/or light chain fragment of any of the illustrative antibodies or fragments thereof that bind to LRP5 and/or LRP6 provided in Table 2B or SEQ ID NOs:66-88 or 133 (or an antigen-binding fragment or variant of either). In certain embodiments, the LRP5/6 binding domain is an Fab or was derived from an Fab, so Table 2B includes VH and CH1 sequence, but not CH2 or CH3 sequences. In certain embodiments, the LRP5/6 binding domain is a VHH or sdAb or was derived from a VHH or sdAb, so Table 2B includes the VHH domain. In certain embodiments, the LRP5/6 binding region is a polypeptide, e.g., an antibody or antigen-binding fragment thereof, that competes with one of these antibodies for binding to LRP5 and/or LRP6.

TABLE 2A

Anti-LRP5/6 Antibody Clone IDs and CDR sequences.

| Clone ID | Confirmed Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 001S-C08 | LRP6e1e2 | YTISNYYIH | 1682 | GMINPSGGST TYA | 1762 | CAIVRGKKWYFDLW | 1842 | RASQYISNYLN | 2098 | AASSLQS | 2110 | CQQSYITPLTF | 2160 |
| 001S-C10 | LRP6e1e2 | RTFGTYPNG | 1632 | AAISWGGRTA YA | 1700 | CYARTVIGGFGAFRA HW | 2061 | | | | | | |
| 001S-D10 | LRP6e1e2 | RTFSRYAMA | 1642 | AAIRWSGGGT YYA | 1689 | CAASMEAMNSLRVN KERYYQSW | 1836 | | | | | | |
| 001S-E10 | LRP6e1e2 | LTFSNAAMA | 1614 | AAISRSGANTA YS | 1696 | CTLVNEIKTWW | 2039 | | | | | | |
| 001S-F10 | LRP6e1e2 | RTFSSYAMA | 1645 | AAIKWSGTNT YYA | 1684 | CAASMEAMNSLRVN KERYYQSW | 1834 | | | | | | |
| 001S-G10 | LRP6e1e2 | RTFSRYVMG | 1644 | AAITWRGGST YYA | 1706 | CATGPNSIY | 1987 | | | | | | |
| 001S-A11 | LRP6e1e2 | RTFGNYDMG | 1630 | AGIRWSGSTL YA | 1709 | CYARTVIGGFGAFRA HW | 2062 | | | | | | |
| 001S-B11 | LRP6e1e2 | RRFTTYGMG | 1623 | AAVTWRSGST YYA | 1708 | CAAGSTVVAEFNYW | 1828 | | | | | | |
| 001S-C11 | LRP6e1e2 | SISSFNTMG | 1659 | AVITTGDTSYS | 1741 | CNKVNAITKL | 2025 | | | | | | |
| 001S-E11 | LRP6e1e2 | RTLSRYSMG | 1651 | AAISRSGDRIY YS | 1697 | CTLVNEIKTWW | 2040 | | | | | | |
| 001S-F11 | LRP6e1e2 | RTFSSYAMS | 1646 | AVIGRSGGIKY YA | 1736 | CATRRPFNSYNTEQS YDSW | 1989 | | | | | | |
| 001S-G11 | LRP6e1e2 | SIFRLGTMY | 1655 | ASIGKSGSTNYA | 1719 | CKQHPNGYR | 2005 | | | | | | |
| 001S-H11 | LRP6e1e2 | RTLSSFAMG | 1652 | ATISRSGGNTY YA | 1732 | CNLREWNNSGAGY W | 2026 | | | | | | |
| 001S-A12 | LRP6e1e2 | IAPRYDMG | 1608 | AAITWNGRSS DYA | 1704 | CAAVFTGRFYGRPPR EKYDYW | 1838 | | | | | | |
| 001S-B12 | LRP6e1e2 | RLLSYYALA | 1622 | AAISRNGDKS HYS | 1694 | CTLVNEIKTWW | 2038 | | | | | | |
| 001S-C12 | LRP6e1e2 | RTFSNYAVG | 1641 | AAISRFGGSTY YV | 1693 | CAADRIENYLGRYYD PSEYEYW | 1824 | | | | | | |

TABLE 2A-continued

Anti-LRP5/6 Antibody Clone IDs and CDR sequences.

| Clone ID | Confirmed Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 001S-D12 | LRP6e1e2 | RFFSRYAMG | 1643 | GAISRSGNNT YYA | 1744 | CTLVNEIKTWW | 2041 | | | | | | |
| 001S-F12 | LRP6e1e2 | RTFRSYTMG | 1637 | AAISGSGGSTT YA | 1690 | CNADIKTTYSPLRNYW | 2009 | | | | | | |
| 008S-B01 | LRP5 | TIFSINTMG | 1664 | ATMTSGGNT NYA | 1734 | CYRQWASSWGAR NYEYW | 2064 | | | | | | |
| 008S-C01 | LRP5 | NINSIETLG | 1617 | ANMRGGGY MKYA | 1716 | CHGRDYGSNAPQYW | 2001 | | | | | | |
| 008S-D01 | LRP5 | NINSIETLG | 1617 | ANMRGGGY MKYA | 1716 | CYVKLRDDDYVYR | 2065 | | | | | | |
| 008S-E01 | LRP5 | NINSIETLG | 1617 | ANMRGGGY MKYA | 1716 | CNAVTYNGYTIR | 2023 | | | | | | |
| 008S-G01 | LRP5 | NINSIETLG | 1617 | ANMRGGGY MKYA | 1716 | CYARTQRMGVVNSYW | 2060 | | | | | | |
| 008S-A02 | LRP5 | NINSIETLG | 1617 | ANMRGGGY MKYA | 1716 | CNAVTFGGNTIR | 2021 | | | | | | |
| 008S-C02 | LRP5 | NINSIETLG | 1617 | ANMRGGGY MKYA | 1716 | CNAVTYDGY | 2022 | | | | | | |
| 008S-D02 | LRP5 | NINSIETLG | 1617 | ANMRGGGY MKYA | 1716 | CAAQFRNDYGLRYQ STNNYW | 1832 | | | | | | |
| 008S-E02 | LRP5 | NINSIETLG | 1617 | ANMRGGGY MKYA | 1716 | CNANYRGNRYW | 2019 | | | | | | |
| 009S-C01 | LRP6e3e4 | GSFSGYYWT | 1595 | GEINHSGATN YN | 1745 | CVRYAWPEFDHW | 2053 | RASQRVSNY LN | 2089 | AASSLQG | 2110 | CQQSYSVPYTF | 2178 |
| 009S-B02 | LRP6e3e4 | GSLSGYYWS | 1596 | GEINHSGSTNYN | 1746 | CVRYAWPEFDHW | 2055 | RASQSISNYLN | 2090 | AASSLQS | 2110 | CQQSYSLPLTF | 2170 |
| 009S-C02 | LRP6e3e4 | GSFSDYYWS | 1594 | GEINHSGSTNYN | 1746 | CVRYAWPEFDHW | 2054 | RASQSISNYLN | 2090 | AASSLQS | 2110 | CQQSYSMPLTF | 2171 |
| 009S-D02 | LRP6e3e4 | GTFSSYAIS | 1603 | GGIIPIFGTANYA | 1749 | CVYGRFDFDYW | 2056 | SGSSSNVGN NVVS | 2105 | DNDKRPS | 2122 | CESWDSSLSSE VF | 2139 |
| 010S-A02 | LRP6e1e2 | HTFSSYAMG | 1607 | AAISQSGYVRYYA | 1691 | CKIYGLNGQPLGSM | 2003 | | | | | | |
| 010S-B02 | LRP6e1e2 | RTFNSGTMG | 1634 | AAITWRGGIT YYA | 1705 | CNADGYSWDGRSG RRLELW | 2008 | | | | | | |

TABLE 2A-continued

Anti-LRP5/6 Antibody Clone IDs and CDR sequences.

| Clone ID | Confirmed Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 010S-D02 | LRP6e1e2 | RTFSSYAVG | 1647 | AAISYSGGSTKYA | 1702 | CAASVVISRRDSDYGYW | 1837 | | | | | | |
| 010S-E02 | LRP6e1e2 | LSSGRPFSSYVMG | 1612 | AAISWSGGSTKYA | 1701 | CKLQVRPIGYSSAYSRNYW | 2004 | | | | | | |
| 010S-F02 | LRP6e1e2 | RSFNSYVIG | 1625 | AAIRWSGDNTYYA | 1688 | CAASMEAMNSLRVNKERYYQSW | 1835 | | | | | | |
| 009S-E02 | LRP6e1e2 | RRFTTYGMG | 1623 | AAVTWRSGSTYYA | 1708 | CAAGSTVVAEFNYW | 1829 | | | | | | |
| 009S-F02 | LRP6e1e2 | RTFSYYAMG | 1649 | AAISRSGGIYYA | 1698 | CNTVRPLWAW | 2029 | | | | | | |
| 009S-G02 | LRP6e1e2 | SIFSIYAMG | 1658 | AVITSGGKTVYA | 1740 | CYADSRSSWYDEYLEHW | 2058 | | | | | | |
| 009S-H02 | LRP6e1e2 | SIVRSLPMA | 1660 | ATINDAQRYYA | 1727 | CNTSPYMHDVW | 2027 | | | | | | |
| 009S-A03 | LRP6e1e2 | RTFSVYGVG | 1648 | AAVSASGGYTWYA | 1707 | CKAAPRWGGATAYW | 2002 | | | | | | |
| 010S-G02 | LRP6e1e2 | SIVRSLPMA | 1660 | ATINDAQRYYA | 1727 | CNTSPYMHDVW | 2028 | | | | | | |
| 010S-A03 | LRP6e1e2 | RTFRRYAMG | 1636 | ATISASGGNTAYA | 1731 | CNAPAWLYDDDYW | 2020 | | | | | | |
| 009S-B03 | LRP6e1e2 | RTFSNYAVG | 1641 | AAISRFGGSTYV | 1693 | CAADRIENYLGRYYDPSEYEYW | 1825 | | | | | | |
| 010S-B03 | LRP6e1e2 | RTFSNYAVG | 1641 | AAISRFGGSTYYA | 1692 | CHAKQLRNGQMYTYW | 1999 | | | | | | |
| 010S-D03 | LRP6e1e2 | ISSVYGMG | 1609 | AAIQWSADNTFYA | 1686 | CAARTSGGLFHYRRSDHWDTW | 1833 | | | | | | |
| 009S-C03 | LRP6e1e2 | LPFSRYAMA | 1610 | AGMSGEGRNTKYR | 1713 | CSSRGYW | 2034 | | | | | | |
| 009S-D03 | LRP6e1e2 | SIFSDGAMG | 1656 | AVISGGRTGYA | 1737 | CNTYPFPIYKKGYPFW | 2030 | | | | | | |
| 009S-E03 | LRP6e1e2 | RRFTTYGMG | 1623 | AAVTWRSGSTYYA | 1708 | CAAGSTVVAEFNYW | 1830 | | | | | | |
| 009S-F03 | LRP6e1e2 | RTFSSYAMS | 1646 | AVIGRSGGIKYA | 1736 | CATRRPFNSYNTEQSYDSW | 1990 | | | | | | |

TABLE 2A-continued

Anti-LRP5/6 Antibody Clone IDs and CDR sequences.

| Clone ID | Confirmed Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 010S-E03 | LRP6e1e2 | RSVSIYPMG | 1628 | AAINWSGDSTKYA | 1685 | CNAVVVGLSRRIDNIW | 2024 | | | | | | |
| 010S-F03 | LRP6e1e2 | RTFSRYVMG | 1644 | AAITWRGGSTYYA | 1706 | CATGPNSIY | 1988 | | | | | | |
| 009S-G03 | LRP6e1e2 | RSVSSYNMG | 1629 | AAISRRGGIIEYG | 1695 | CHAVENILGRFVDYW | 2000 | | | | | | |
| 009S-H03 | LRP6e1e2 | SIFSINTMG | 1657 | AVITSGGKTVYA | 1740 | CYADSRSSWYDEYLEHW | 2057 | | | | | | |
| 009S-A04 | LRP6e1e2 | RTLSAYDMG | 1650 | GGIRWSGGTTLYP | 1753 | CYARTVIGGFGAFRAHW | 2063 | | | | | | |
| 009S-B04 | LRP6e3e4 | SIFMINTMA | 1654 | ATIRPVVSETTYA | 1728 | CNAKRPWGTRDEYW | 2018 | | | | | | |
| 010S-G03 | LRP6e3e4 | RSFNSYTTT | 1624 | AAIRGSSGSTFYA | 1687 | CNAASTVTAMPYYGPDYW | 2006 | | | | | | |
| 009S-C04 | LRP6e3e4 | FRFSISTMG | 1553 | AYITGGGRTMDG | 1743 | CNAFVRSDFDRYDYW | 2011 | | | | | | |
| 009S-D04 | LRP6e3e4 | TIVSIYRIN | 1665 | AGITSSGRTIYA | 1712 | CNAASTVTAMPYYGPDYW | 2007 | | | | | | |
| 010S-H03 | LRP6e3e4 | RIFSIYDMG | 1621 | SGIRWSGGTSYA | 1789 | CSSRGYW | 2035 | | | | | | |
| 009S-E04 | LRP6e3e4 | RIFAIYDIA | 1618 | AMIRPVVTEIDYA | 1715 | CNAKRPWGSRDEYW | 2012 | | | | | | |
| 010S-A04 | LRP6e3e4 | SLFSFNAVG | 1662 | ASISSGGRTNYA | 1722 | CSKGGVIGGTYVPDSW | 2032 | | | | | | |
| 009S-F04 | LRP6e3e4 | RSLSSFAMG | 1627 | ARISRGDGYTDEA | 1718 | CAAVQAVIGGTLTTAYDYW | 1839 | | | | | | |
| 010S-B04 | LRP6e3e4 | RVLSYYAMA | 1653 | AGITRGGATTYS | 1711 | CAAGPNWSTRNREYDYW | 1827 | | | | | | |
| 009S-G04 | LRP6e3e4 | GTFSRYHMG | 1601 | SAITWSGGRTYYA | 1788 | CALTWAPTPTNRRSDYAYW | 1872 | | | | | | |
| 009S-H04 | LRP6e3e4 | RIFAIYDMA | 1619 | ATIRPVVSETTYA | 1728 | CNAKRPWGTRDEYW | 2017 | | | | | | |

TABLE 2A-continued

Anti-LRP5/6 Antibody Clone IDs and CDR sequences.

| Clone ID | Confirmed Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 010S-C04 | LRP6e3e4 | SLFSFNAMG | 1661 | ASISSGSRTNYA | 1723 | CSKGGVVGGTVVPDSW | 2033 | | | | | | |
| 010S-D04 | LRP6e3e4 | RIFAIYDIA | 1618 | ATIRPVVTQIDYA | 1730 | CNAKRPWGSRDEYW | 2015 | | | | | | |
| 010S-E04 | LRP6e3e4 | RTFGSDVMG | 1631 | ALTGWGDGSTTYYE | 1714 | CAAARRSGTYDIGQYLRESAYVFW | 1820 | | | | | | |
| 010S-F04 | LRP6e3e4 | RTFSRYAMG | 1643 | AAITRSGSNTYYA | 1703 | CAADPRGVTLPRATAYEYW | 1823 | | | | | | |
| 009S-A05 | LRP6e3e4 | RTFSDYSMG | 1639 | AGISWIADNRYYA | 1710 | CTAGRSRYLYGSSLNGPYDYW | 2036 | | | | | | |
| 010S-G04 | LRP6e3e4 | VIFAIYDIA | 1666 | ATIRPVVTETDYA | 1729 | CNAKRPWGSRDEYW | 2014 | | | | | | |
| 010S-H04 | LRP6e3e4 | RSFSDFFMG | 1626 | ATISWSGSSANYE | 1733 | CAAAYSYSQYGSSYSYW | 1821 | | | | | | |
| 010S-A05 | LRP6e3e4 | LSFSSYAMG | 1611 | AAISRSGVSTYYA | 1699 | CAAKFGVLATTESRHDYW | 1831 | | | | | | |
| 010S-C05 | LRP6e3e4 | RTFNIDDMG | 1633 | ASIRWSGQSPYYA | 1720 | CNAETYSGNTIW | 2010 | | | | | | |
| 010S-D05 | LRP6e3e4 | RTFSDYSMA | 1638 | AGISWIADNRYYA | 1710 | CAGDRSRYLYGDSLRGPYGYW | 1841 | | | | | | |
| 010S-E05 | LRP6e3e4 | SVFTTFAKG | 1663 | ASITASSDRTFYA | 1725 | CAAYSTFNTDVASMKPDYW | 1840 | | | | | | |
| 010S-F05 | LRP6e3e4 | RIFSIYDIA | 1620 | ATIRPVVTETDYA | 1729 | CNAKRPWGSRDEYW | 2013 | | | | | | |
| 010S-G05 | LRP6e3e4 | RIFAIYDIA | 1618 | ATIRPVVSETTYA | 1728 | CNAKRPWGTRDEYW | 2016 | | | | | | |
| 013S-H04 | LRP6e3e4 | RFSMYDMG | 1640 | ASIRWSSGNTWYA | 1721 | CYANIYYTRRAPEEYW | 2059 | | | | | | |
| 013S-A05 | LRP6e3e4 | RTFNTYAMG | 1635 | ASVSWRYDRTYYT | 1726 | CAADTNWRAGPRVGIDEYAYW | 1826 | | | | | | |
| 013S-B05 | LRP6e3e4 | FAFSTTAMS | 1549 | STINPGGLSKSYA | 1806 | CTKGGIQ | 2037 | | | | | | |

TABLE 2A-continued

Anti-LRP5/6 Antibody Clone IDs and CDR sequences.

| Clone ID | Confirmed Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 013S-C05 | LRP6e3e4 | NIFPIDDMS | 1616 | ATVTSGGRINYA | 1735 | CNVDRTLYGKYKEYW | 2031 | | | | | | |
| 013S-D05 | LRP6e3e4 | RIFSIYDMG | 1621 | SGIRWSGGTS YA | 1789 | CGSRGYW | 1998 | | | | | | |
| 013S-E05 | LRP6e3e4 | YTFTYRYLH | 1681 | GGIPIFGTADYA | 1748 | CARDWELYGMDVW | 1907 | RASQSISSYLN | 2094 | AASSLQS | 2110 | CQQSYSTPLTF | 2174 |
| 013S-F05 | LRP6e3e4 | GTFSSYAIS | 1603 | GIINPSGGSTSYA YA | 1761 | CARAGYDSSGYYAF DIW | 1882 | RASQSISSYLN | 2094 | AASSLQS | 2110 | CQQSYSTPLTF | 2174 |
| 013S-G05 | LRP6e3e4 | YTFTYRYLH | 1681 | GGVIPIFGTAD YA | 1755 | CASDIVDDAFDTW | 1969 | RASQDISNY LN | 2079 | AASTLQS | 2113 | CQQGNSFPYTF | 2152 |
| 010S-G05 | LRP6e3e4 | FSFETYGMS | 1555 | SGISGSGGRTH YA | 1792 | CARDLDYW | 1897 | QASQDISNY LN | 2077 | AASSLQS | 2110 | CQQSYRIHWTF | 2163 |
| 009S-B05 | LRP6e3e4 | FTFDAYAMH | 1560 | STLSGDANNA YYA | 1811 | CARGGSGWSNYYG MDVW | 1931 | RASQSISSYLN | 2094 | AASSLQS | 2110 | CQQSYSTPLTF | 2174 |
| 009S-C05 | LRP6e3e4 | YTFTYRYLH | 1681 | GRIIPVLKITNYA | 1768 | CAVVDDAFDIW | 1996 | | | | | | |
| 009S-D05 | LRP6e3e4 | FTLRNHWLS | 1591 | SAISGSGGSTY YA | 1786 | CATRTGYSYGFNFW AFDIW | 1991 | RASQSISSYLN | 2904 | AASSLQS | 2110 | CQQSYSTPLTF | 2174 |
| 009S-E05 | LRP6e3e4 | YTFTNNFMH | 1676 | GHVDPGDGET IYA | 1756 | CARDWGIAAAGDYY YYGMDVW | 1908 | RASQGINSY LA | 2081 | DAKGLHP | 2114 | CQQSYSAPLSF | 2166 |
| 009S-F05 | LRP6e3e4 | FTFDDYGMS | 1561 | SAIGTGGGTYYA | 1781 | CARLGSYGSPYYYG MDVW | 1959 | RASQSISSYLN | 2094 | AASSLQS | 2110 | CQQSYSTPLTF | 2174 |
| 009S-G05 | LRP6e3e4 | FTFSDYYMS | 1568 | SGVSWNGSRT HYA | 1799 | CAKDSGLV | 1852 | QASQDISNY LN | 2077 | AASTLQR | 2112 | CQQSYSAPLTF | 2167 |
| 009S-C06 | LRP6e3e4 | YTFASYDIH | 1671 | GWMNPNSG NTGYA | 1776 | CARATGSGWYTDLG YW | 1883 | RASRNINRY LN | 2099 | AASSLLS | 2109 | CQQSYNVPFTF | 2162 |
| 009S-D06 | LRP6e3e4 | FTFSSHSTH | 1573 | STISDTNSGTY YA | 1807 | CAKAQATGWSGYYT FDYW | 1843 | RASQSISSYLN | 2094 | AASSLQS | 2110 | CQQSYSTPLTF | 2174 |
| 009S-E06 | LRP6e3e4 | FTFTDYGLH | 1587 | AVISYGGSNKY YA | 1739 | CASGYSYGLYYYGM DVW | 1973 | RASQSISSYLN | 2094 | AASSLQS | 2110 | CQQSYSTPLTF | 2174 |
| 009S-F06 | LRP6e3e4 | YTFTYRYLH | 1681 | GGIPIFGTAN YA | 1749 | CATEAALDAFDIW | 1985 | RASQSISSYLN | 2094 | AASSLQS | 2110 | CQQSYSTPLTF | 2174 |
| 009S-G06 | LRP6e3e4 | YIFTDYYMH | 1669 | GWINPNSGGT NYA | 1774 | CARDFLGSTGDYW | 1892 | RASQNIGLY LN | 2088 | DASSLQR | 2121 | CQQSYSTPYTF | 2176 |

TABLE 2A-continued

Anti-LRP5/6 Antibody Clone IDs and CDR sequences.

| Clone ID | Confirmed Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 009S-H06 | LRP6e3e4 | FTFSSSAMH | 1574 | SAIGTGGSTYYA | 1783 | CAKGGDYFYYYGMDVW | 1856 | RASQSISSYLN | 2094 | AASLQS | 2110 | CQQSYSTPLTF | 2174 |
| 009S-A07 | LRP6e3e4 | YTFTYRYLH | 1681 | GGIPIFGTANYA | 1749 | CATAYGSSSLNIDYW | 1980 | RASQSISSYLN | 2094 | AASSLQS | 2110 | CQQSYSTPLTF | 2174 |
| 009S-B07 | LRP6e3e4 | YTFTGYYMH | 1675 | GWINPNSGGTNYA | 1774 | CVKDGGSFPLAYAFDIW | 2049 | RASQSISSYLN | 2904 | AASLQS | 2110 | CQQSYSTPLTF | 2174 |
| 009S-D07 | LRP6e3e4 | FPPRYYGMS | 1551 | ARIGWNGGSIVYA | 1717 | CARDYSDRSGIDYW | 1910 | RSSQSLLHSNGYNYLD | 2102 | LGSNRAS | 2131 | CMQATQFPLTF | 2146 |
| 009S-F07 | LRP6e3e4 | GTFSSSYAIS | 1603 | GIINPSGGSTSYA | 1761 | CARAAGNFWSGYYTFDYW | 1876 | RASQSISSYLN | 2094 | AASSLQS | 2110 | CQQSYSTPLTF | 2174 |
| 009S-G07 | LRP6e3e4 | YTFTYRYLH | 1681 | GGIPIFGTANYA | 1749 | CARGSYGMDVW | 1947 | RASQGISNYLA | 2083 | DASNLET | 2115 | CLQDFSFPWTF | 2140 |
| 009S-H07 | LRP6e3e4 | YTFTGYYMH | 1675 | GWMNPNSGNTGYA | 1776 | CASSVVPAGPAGVYAFDIW | 1975 | RASQSISSYLN | 2094 | AASSLQS | 2110 | CQQSYSTPLTF | 2174 |
| 009S-A08 | LRP6e3e4 | GTFSSHAIN | 1602 | GWISANNGNTDYA | 1775 | CARDQDYGDYGWYYYGMDVW | 1902 | RASQGISNYLA | 2083 | GSSTLQS | 2127 | CQQTYSIPPTF | 2181 |
| 011S-C01 | LRP6e3e4 | LTFTSHGMS | 1615 | SYVSDSGSSVYYA | 1818 | CARHPGSFGGYSYAWYYYYGMDVW | 1956 | RASQSISSYLN | 2094 | AASSLQS | 2110 | CQQSYSTPLTF | 2174 |
| 009S-C08 | LRP6e3e4 | FSFNTFGIH | 1556 | AVISYDGSNKYYA | 1738 | CAKSIAAAGTGYYGMDVW | 1868 | RASQSISSYLN | 2094 | AASSLQS | 2110 | CQQSYSTPLTF | 2174 |
| 009S-D08 | LRP6e3e4 | YTFTSYDIN | 1679 | GGIPIFGTANYA | 1749 | CARGPYYFDYW | 1939 | RASQGISNNLN | 2082 | DASSLES | 2120 | CLQHNSYPFTF | 2143 |
| 011S-F01 | LRP6e3e4 | FSFSDYYMS | 1558 | SGISESGGRTYA | 1790 | CASAADFDYW | 1966 | RASQDISNYLN | 2079 | AASSLQS | 2110 | CLQDYSYPRTF | 2141 |
| 009S-E08 | LRP6e3e4 | TGFTGYYIH | 1668 | GWMNPNSGNTGYA | 1776 | CARGYGDYDLW | 1951 | QASQDISNYLN | 2077 | DASSLES | 2120 | CQQSYRPTF | 2165 |
| 009S-F08 | LRP6e3e4 | DTFANYGFS | 1547 | GXVNAGNGNTTYA | 1777 | CAKGWLDFDYW | 1866 | QASQDISNYLN | 2077 | DASSLES | 2120 | CQQSYSTSITF | 2177 |
| 009S-G08 | LRP6e3e4 | FTFSDFAMT | 1566 | SYISGDSGYTNYA | 1813 | CARLGSYPGPYYYMDVW | 1961 | RASQSISSYLN | 2094 | AASSLQS | 2110 | CQQSYSTPLTF | 2174 |
| 009S-H08 | LRP6e3e4 | YTFTDYFMN | 1673 | GIINPSGDSTRFA | 1758 | CARDDGLGGMDVW | 1888 | QASQDISNYLA | 2076 | AASSLQS | 2110 | CQQSYSTPLTF | 2174 |

TABLE 2A-continued

Anti-LRP5/6 Antibody Clone IDs and CDR sequences.

| Clone ID | Confirmed Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 009S-A09 | LRP6e3e4 | YTFTYRYLH | 1681 | GRIIPILGSTNYA | 1767 | CTTDLWDYW | 2047 | QASQGITNYLN | 2078 | AASSLQS | 2110 | CLQDYTDPFTF | 2142 |
| 011S-F02 | LRP6e3e4 | FTFSTYGMH | 1584 | SSISVSSGTTHYA | 1804 | CARGGSGSYYYAFDIW | 1929 | RASQSISSYLN | 2094 | AASSLQS | 2110 | CQQSYSTPLTF | 2174 |
| 011S-G02 | LRP6e3e4 | YTFTSYAMN | 1678 | GGIIPIFGTANYA | 1749 | CARDASGGSTGWYYFDSW | 1886 | RASQSISSYLA | 2087 | AASSLQS | 2110 | CQQAVSFPWTF | 2150 |
| 011S-A03 | LRP6e3e4 | FTFSSYWMH | 1580 | STISGSGGRTYYA | 1808 | CATSPYGVFTLDYW | 1993 | RASQSISSYLN | 2094 | AASSLQS | 2110 | CQQSYSTPLTF | 2174 |
| 011S-C03 | LRP6e3e4 | YTFSYRYLH | 1672 | GGIIPIFGTANYA | 1749 | CASTVTTDAPDIW | 1977 | QASQDISNYLN | 2077 | DASSLES | 2120 | CQQSYSFPPFTF | 2168 |
| 011S-D03 | LRP6e3e4 | FSFDDYGMS | 1554 | SVISSGGTIYYA | 1812 | CARHLSSGYLSYYGMDVW | 1954 | RASQSISSYLA | 2093 | AASTLQS | 2113 | CQQSYSTPLTF | 2174 |
| 011S-F03 | LRP6e3e4 | FTFSSYAMS | 1577 | SAISGSGGSTYYA | 1786 | CAKGGRDGVKGYFDYW | 1859 | KSSQSVLYTTNRNHIA | 2073 | WASSRKS | 2135 | CQQYSTPYTF | 2189 |
| 011S-C04 | LRP6e1e2 | GTFNSNAIS | 1598 | GWMNPNSGNTGYA | 1776 | CARDYYGSGSYNYGMDVW | 1912 | GASQSVPRNSLA | 2066 | GASQRAT | 2124 | CQQYHNWPPEYTF | 2184 |
| 011S-D04 | LRP6e1e2 | YTFTSYDIN | 1679 | GIINPSGGSTSYA | 1761 | CAREAYYYYYGMDVW | 1915 | RASQSISSYLN | 2094 | AASSLQS | 2110 | CQQSYSTPLTF | 2174 |
| 011S-H04 | LRP6e1e2 | YIFTDYYMH | 1669 | GRIIPILGRANYA | 1765 | CARGGYSTLDYW | 1932 | QASQDISNYLN | 2077 | AASTLQS | 2113 | CQQSFSTPRTF | 2156 |
| 008S-F02 | LRP5 | YTFTNYCMH | 1677 | GIINPSDGSTSHA | 1757 | CAKDMVHLIVALAIDYW | 1851 | RSSQSLLHSDGYTYLY | 2101 | TLSYRAS | 2134 | CMQALEALFTF | 2144 |
| 010S-C06 | LRP6e1e2 | FTFNSYSMD | 1563 | SSISPRGGSTYYA | 1802 | CAPYYYDKSAKPLRSYFDHW | 1875 | RASQSISSYLN | 2094 | AASSLQS | 2110 | CQQSYSTPLTF | 2174 |
| 010S-E06 | LRP6e3e4 | LTVSSNYMS | 1615 | SGISWNSGSIGYA | 1796 | CARGSDCSGGSCYYSFDYW | 1944 | RASQSISSYLN | 2094 | AASSLQS | 2110 | CQQSYSTPLTF | 2174 |
| 010S-F06 | LRP6e3e4 | FTFSSSWMH | 1575 | SAIGTGGGTYYA | 1781 | CAREVAVKDYYYYYMDVW | 1921 | RASQSISSYLN | 2094 | AASSLQS | 2110 | CQQSYSTPLTF | 2174 |
| 010S-H06 | LRP6e3e4 | YTFTSYDIN | 1679 | GRIIPILGRTNYA | 1766 | CARERGATGRAPFDIW | 1918 | RASQSISSYLN | 2094 | AASSLQS | 2110 | CQQSYSTPLTF | 2174 |
| 010S-A07 | LRP6e3e4 | FTFSSYAMH | 1576 | ASISSTSGSKYYA | 1724 | CAKTYYDFWSGYYTFDYW | 1870 | RASQSISSYLN | 2094 | AASSLQS | 2110 | CQQSYSTPLTF | 2174 |

TABLE 2A-continued

Anti-LRP5/6 Antibody Clone IDs and CDR sequences.

| Clone ID | Confirmed Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 010S-B07 | LRP6e3e4 | FTFSDYYMS | 1568 | SMISYNGGRAFYA | 1800 | CARGNPYYFDYW | 1937 | RASQSISSYLN | 2094 | AASSLQS | 2110 | CQQSYSTPLTF | 2174 |
| 010S-C07 | LRP6e3e4 | FTFSKTDMH | 1569 | STITTDSRGTY | 1810 | CAKGGDYYYYYGMDVW | 1858 | RASQSISSYLN | 2094 | AASSLQS | 2110 | CQQSYSTPLTF | 2174 |
| 010S-D07 | LRP6e3e4 | YTFTYRYLH | 1681 | GGIIPIFGTANYA | 1749 | CANGLEDAYAFDIW | 1873 | RASQSISSYLN | 2094 | AASSLQS | 2110 | CQQSYSTPLTF | 2174 |
| 009S-D05 | LRP6e3e4 | FTLRNHWLS | 1591 | SAISGSGGSTYYA | 1786 | CATRTGYSYGFNFWAFDIW | 1992 | RASQSISSYLN | 2094 | AASSLQS | 2110 | CQQSYSTPLTF | 2174 |
| 009S-E05 | LRP6e3e4 | YTFTNNFMH | 1676 | GHVDPDGETIYA | 1756 | CARDWGIAAAGDYYYYGMDVW | 1909 | RASQGINSYLA | 2081 | DAKGLHP | 2114 | CQQSYSAPLSF | 2166 |
| 010S-E07 | LRP6e3e4 | YTFTYRYLH | 1681 | GGIIPIFGTANYA | 1749 | CAKDDFSLYGMDVW | 1845 | RASQSISSYLN | 2094 | AASSLQS | 2110 | CQQSYSTPLTF | 2174 |
| 009S-F05 | LRP6e3e4 | FTFDDYGMS | 1561 | SAIGTGGGTYYA | 1781 | CARLGSYGSPYYYYGMDVW | 1960 | RASQSISSYLN | 2094 | AASSLQS | 2110 | CQQSYSTPLTF | 2174 |
| 010S-F07 | LRP6e3e4 | YTFTYRYLH | 1681 | GGIIPIFGTANYA | 1749 | CARLDYGETENGDW | 1958 | RVSQSVYSNLA | 2097 | DTSNRAT | 2123 | CQQYNMWPPITF | 2185 |
| 010S-G07 | LRP6e3e4 | FTFSSYAMH | 1576 | STISGSGGSTYYA | 1809 | CARAGYGRYYYYGMDVW | 1880 | RVSQGISSYLN | 2103 | AASSLQS | 2110 | CQQYTIPFTF | 2182 |
| 009S-G05 | LRP6e3e4 | FTFSDYYMS | 1568 | SGVSWNGSRTHYA | 1799 | CAKDSGLV | 1853 | QASQDISNYLN | 2077 | AASTLQR | 2112 | CQQSYSAPLTF | 2167 |
| 010S-H07 | LRP6e3e4 | YTFTYRYLH | 1681 | GGIIPIFGTANYA | 1749 | CARDDSMGAPFDIW | 1890 | QASQDISNYLN | 2077 | GTSNLQS | 2128 | CQQSYSTPYTF | 2176 |
| 010S-A08 | LRP6e3e4 | HTFLTYDIN | 1606 | GRITPRLGIANYA | 1770 | CASYFGVMDVW | 1979 | RASQSISSYLN | 2094 | AASSLQS | 2110 | CQQSYSTPLTF | 2174 |
| 009S-A07 | LRP6e3e4 | YTFTYRYLH | 1681 | GGIIPIFGTANYA | 1749 | CATAYGSSSLNIDYW | 1981 | RASQSISSYLN | 2094 | AASSLQS | 2110 | CQQSYSTPLTF | 2174 |
| 009S-B07 | LRP6e3e4 | YTFTGYYMH | 1675 | GWINPNSGGTNYA | 1774 | CVKDGGSFPLAYAFDIW | 2050 | RASQSISSYLN | 2094 | AASSLQS | 2110 | CQQSYSAPLTF | 2174 |
| 009S-B06 | LRP6e3e4 | YTFTYRYLH | 1681 | GGIIPIFGTANYA | 1749 | CAPALTDAGSFDYW | 1874 | RVSQSISSYLN | 2103 | AASSLQS | 2110 | CQQSYSTPLTF | 2174 |
| 010S-B08 | LRP6e3e4 | YTFTYRYLH | 1681 | GGIIPVFGTADYA | 1751 | CARDREQQILDYW | 1904 | RASQGISNNLN | 2082 | DASNLET | 2115 | CQQSYTSRLTF | 2179 |

TABLE 2A-continued

Anti-LRP5/6 Antibody Clone IDs and CDR sequences.

| Clone ID | Confirmed Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 010S-C08 | LRP6e3e4 | FTFSTFGMH | 1582 | STITSGGSTYYA | 1809 | CARAGIAAAPGSRNYYGMDVW | 1878 | RASQSISSYLN | 2094 | AASSLQS | 2110 | CQQSYSTPLTF | 2174 |
| 009S-C06 | LRP6e3e4 | YIFASYDIH | 1671 | GWMNPNSGNTGYA | 1776 | CARATGSGWYTDLGYW | 1884 | RASRNINRYLN | 2099 | AASSLLS | 2109 | CQQSYNVPFTF | 2162 |
| 009S-D06 | LRP6e3e4 | FTFSSHSTH | 1573 | STISDTNSGTYA | 1807 | CAKAQATGWSGYYTFDYW | 1844 | RASQSISSYLN | 2094 | AASSLQS | 2110 | CQQSYSTPLTF | 2174 |
| 010S-D08 | LRP6e3e4 | FTFSSSWMH | 1575 | SAIGTGGSTYYA | 1781 | CAKEDYDSSGYYYYFQHW | 1855 | RASQSISSYLN | 2094 | AASSLQS | 2110 | CQQSYSTPLTF | 2174 |
| 009S-E06 | LRP6e3e4 | FTFTDYGLH | 1587 | AVISYGGSNKYYA | 1739 | CASGYSYGLYYYGMDVW | 1974 | RASQSISSYLN | 2094 | AASSLQS | 2110 | CQQSYSTPLTF | 2174 |
| 010S-E08 | LRP6e3e4 | YSFTRTDMH | 1670 | GYISAYTGHTSYA | 1778 | CARDLGGTADYW | 1898 | RASQSISSYLN | 2094 | ZASSLQS | 2137 | CQQSYSTPLTF | 2174 |
| 010S-F08 | LRP6e3e4 | LIFDDHAMH | 1613 | SYISSSGRTIFYA | 1815 | CVRGDSGWGILYYVMDVW | 2052 | RASQSISSYLN | 2094 | AASSLQS | 2110 | CQQSYSTPLTF | 2174 |
| 009S-F06 | LRP6e3e4 | YTFTYRYLH | 1681 | GGIIPIFGTANYA | 1749 | CATEAALDAFDIW | 1986 | RASQSISSYLN | 2094 | AASSLQS | 2110 | CQQSYSTPLTF | 2174 |
| 010S-G08 | LRP6e3e4 | YIFTDYYMH | 1669 | GGFDPEDGETIYA | 1747 | CARGGGPNEHDYYFDYW | 1927 | RASQSVRSSDLA | 2096 | GSSSRAT | 2126 | CQQYGRSPRYSF | 2183 |
| 010S-H08 | LRP6e3e4 | FTFZNAWMS | 1590 | SGISGSGGSTYYA | 1793 | CARGRGKNYYYGMDVW | 1942 | RASQSISSYLN | 2094 | AASSLQS | 2110 | CQQSYSTPLTF | 2174 |
| 010S-A09 | LRP6e3e4 | FTFSTYYMS | 1586 | SGISWNGGKTHYV | 1794 | CARGGDFDYW | 1925 | QASQDIANYLN | 2075 | AASSLQS | 2110 | CQQSYSTPYTF | 2176 |
| 010S-B09 | LRP6e3e4 | GTFSSYAIS | 1603 | GWINPNSGDTNYA | 1773 | CARGEQWLVWGFDPW | 1924 | RASQSISRYLN | 2092 | KASSLES | 2130 | CQQSYDSPWTF | 2159 |
| 009S-G06 | LRP6e3e4 | YIFTDYYMH | 1669 | GWINPNSGGTNYA | 1774 | CARDPLGSTGDYW | 1893 | RASQNIGLYLN | 2088 | DASSLQR | 2121 | CQQSYSTPYTF | 2176 |
| 010S-C09 | LRP6e3e4 | YIFTYRYLH | 1681 | GGIIPIFGTANYA | 1749 | CARDEVEGGMDVW | 1891 | RASQSISSYLN | 2094 | AASSLQS | 2110 | CQQSYSTPLTF | 2174 |
| 009S-H06 | LRP6e3e4 | FTFSSSAMH | 1574 | SAIGTGGSTYYA | 1783 | CAKGGDYFYYYGMDVW | 1857 | RASQSISSYLN | 2094 | AASSLQS | 2110 | CQQSYSTPLTF | 2174 |
| 010S-D09 | LRP6e3e4 | GTFSSYTIS | 1603 | GGIVPAYRRANYA | 1754 | CAKGGYELDYW | 1865 | QASQDISNYLN | 2077 | AASSLQS | 2110 | CQQIHSYPLTF | 2155 |

TABLE 2A-continued

Anti-LRP5/6 Antibody Clone IDs and CDR sequences.

| Clone ID | Confirmed Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 010S-E09 | LRP6e3e4 | GDLSIYTIN | 1593 | GWINAGNGNTTYA | 1772 | CARGGDSSGYYYAFDIW | 1926 | RASQSISSYLN | 2094 | AASSLQS | 2110 | CQQSYSTPLTF | 2174 |
| 009S-A07 | LRP6e3e4 | YTFTYRYLH | 1681 | GGIIPIFGTANYA | 1749 | CATAYGSSSLNIDYW | 1982 | RASQSISSYLN | 2094 | AASSLQS | 2110 | CQQSYSTPLTF | 2174 |
| 009S-B07 | LRP6e3e4 | YTFTGYYMH | 1675 | GWINPNSGGTNYA | 1774 | CVKDGSFPLAYAFDIW | 2051 | RASQSISSYLN | 2094 | AASSLQS | 2110 | CQQSYSTPLTF | 2174 |
| 009S-D08 | LRP6e3e4 | YTFTSYDIN | 1679 | GGIIPIFGTANYA | 1749 | CARGPYYFDYW | 1940 | RASQSISNNLN | 2082 | DASSLES | 2120 | CLQHNSYPPTF | 2143 |
| 010S-F09 | LRP6e3e4 | FTFDEYAMH | 1562 | STISGSGGSTYYA | 1809 | CASAKNDFWSGYFAFDYW | 1968 | RASQSISSYLN | 2094 | AASSLQS | 2110 | CQQSYSTPLTF | 2174 |
| 010S-G09 | LRP6e3e4 | GTFNTHTIT | 1599 | GWMNPNSGNTGYA | 1776 | CARGNLDFDYW | 1936 | QASQDISNYLN | 2077 | DASNLET | 2115 | CQQSYSTPLTF | 2174 |
| 010S-H09 | LRP6e3e4 | FTFSDHYMS | 1567 | SAISSGSDRTYYA | 1787 | CARYSGYFDFDYW | 1965 | RASQGISNYLN | 2084 | AATSLQS | 2113 | CQQGYGTPPMF | 2153 |
| 010S-A10 | LRP6e3e4 | FSFSSYSMN | 1559 | SYISSSSSTIYYA | 1816 | CARGSGYYGPGYYGMDVW | 1946 | RASQSISSYLN | 2094 | AASSLQS | 2110 | CQQSYSTPLTF | 2174 |
| 009S-D07 | LRP6e3e4 | FPPFRYYGMS | 1551 | ARIGWNGGSIVYA | 1717 | CARDYSDRSGIDYW | 1911 | RSSQSLLHSNGYNYLD | 2102 | LGSNRAS | 2131 | CMQATQFPLTF | 2146 |
| 010S-B10 | LRP6e3e4 | FAFKDYYMT | 1548 | SAIGAGGGTYYA | 1779 | CARESALYSSSWYYYYYGMDVW | 1920 | RASQSISSYLN | 2094 | AASSLQS | 2110 | CQQANSFPFTF | 2148 |
| 010S-C10 | LRP6e3e4 | FTFSSYAMS | 1577 | SAISGSGGSTYYA | 1786 | CAKGGRDGYKGYFDYW | 1860 | KSSQSILSSSNRDSLA | 2072 | GTSSLHT | 2129 | CQQYYNIPYSF | 2187 |
| 009S-E07 | LRP6e3e4 | YTFTGYYIH | 1674 | ZHVDPEDGETIYA | 1819 | CARGPAAIGILGWFDPW | 1938 | RASQSISSYLN | 2094 | AASSLQS | 2110 | CQQSYSTPLTF | 2174 |
| 010S-D10 | LRP6e3e4 | YIFTDYYMH | 1669 | GWMNPNSGNTGYA | 1776 | CARTLSGYSSSWYVFDYW | 1964 | RASQSISSYLN | 2094 | AASSLQS | 2110 | CQQSYSTPLTF | 2174 |
| 010S-E10 | LRP6e3e4 | FTFSSYSMN | 1579 | SGISWNSGTTGYS | 1797 | CARDHSSGWRHYFDYW | 1895 | RASQSISSYLN | 2094 | AASSLQS | 2110 | CQQSYSTPLTF | 2174 |
| 010S-F10 | LRP6e3e4 | FTFSNSDMN | 1570 | SYISGNSGYTNYA | 1814 | CASGSYYSDFDYW | 1971 | RASQSISNVLN | 2090 | AASTLES | 2111 | CQQANSFPPTF | 2148 |
| 010S-G10 | LRP6e3e4 | GTFSSYAIS | 1603 | GRINPNGGGTIYA | 1769 | CAREGGYYFDYW | 1919 | RASQGISNYLA | 2083 | AASSLQS | 2110 | CQQSYSTPWTF | 2175 |

TABLE 2A-continued

Anti-LRP5/6 Antibody Clone IDs and CDR sequences.

| Clone ID | Confirmed Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 009S-F07 | LRP6e3e4 | GTFSSYAIS | 1603 | GIINPSGGSTS YA | 1761 | CARAAGNFWSGYYT FDYW | 1877 | RASQSISSYLN | 2094 | AASSLQS | 2110 | CQQSYSTPLTF | 2174 |
| 009S-G07 | LRP6e3e4 | YTFTYRYLH | 1681 | GGIIPIFGTAN YA | 1749 | CARGSYGMDVW | 1948 | RASQGISNY LA | 2083 | DASNLET | 2115 | CLQDFSFPWTF | 2140 |
| 010S-H10 | LRP6e3e4 | YTFTSYYMH | 1680 | GWINPNSGGT NYA | 1774 | CAREAAEIPVGAFDIW | 1914 | KSSHSLLYSS DNKNYLA | 2071 | WSSTRES | 2136 | CQQYYSTPQTF | 2188 |
| 010S-A11 | LRP6e3e4 | FTFSNSDMN | 1570 | SYISGNSGYTN YA | 1814 | CASGSYYSDFDYW | 1972 | RASQSIZNVLN | 2095 | ZASTLES | 2138 | CQQANSFPPTF | 2148 |
| 010S-B11 | LRP6e3e4 | FTFRNYAIH | 1564 | SAIGTGDFTYYA | 1780 | CARDGGIRDFDYW | 1894 | QASQDISNY LN | 2077 | AASTLQS | 2113 | CQQSYSTPLTF | 2174 |
| 010S-C11 | LRP6e3e4 | YTFTYRYLH | 1681 | GGIIPIFGTAN YA | 1749 | CAADDLGLELHYW | 1822 | RASQSISSYLN | 2094 | AASSLQS | 2110 | CQQSYSTPLTF | 2174 |
| 009S-H07 | LRP6e3e4 | YTFTGYYMH | 1675 | GWMNPNSG NTGYA | 1776 | CASSVVPAGPAGVY AFDIW | 1976 | RASQSISSYLN | 2094 | AASSLQS | 2110 | CQQSYSTPLTF | 2174 |
| 009S-A08 | LRP6e3e4 | GTFSSHAIN | 1602 | GWISANNGN TDYA | 1775 | CARDQDYGDYGWY YYGMDVW | 1903 | RASQGISNY LA | 2083 | GSSTLQS | 2127 | CQQTYSIPPTF | 2181 |
| 010S-D11 | LRP6e3e4 | YTFTYRYLH | 1681 | GGIIPVFGTAN YA | 1752 | CATDEYSSSYAFDIW | 1983 | RASQSVSSN LA | 2097 | GASTRAT | 2125 | CQQFDRSPLTF | 2151 |
| 010S-E11 | LRP6e3e4 | FTFSAHGMH | 1565 | SGISESGGSTY YA | 1791 | CARGRGYSYGYYAFD IW | 1943 | RASQSISSYLN | 2094 | AASSLQS | 2110 | CQQSYSTPLTF | 2174 |
| 010S-F11 | LRP6e3e4 | YTFTYRYLH | 1681 | GGIIPIFGTAN YA | 1749 | CARDSDWGVVDPW | 1905 | RASQSISSYLN | 2094 | AASSLQS | 2110 | CQQSYSTPLTF | 2174 |
| 010S-G11 | LRP6e3e4 | YTFTYRYLH | 1681 | GRIIPVLKITNYA | 1768 | CAVVDDAFDIW | 1997 | RASQSISSYLN | 2094 | AASSLQS | 2110 | CQQSYSTPLTF | 2174 |
| 010S-H11 | LRP6e3e4 | YTFTYRYLH | 1681 | GGIIPIFGTAN YA | 1749 | CAKDGTDGRFDPW | 1846 | RASQDISSYLA | 2080 | SASTLQS | 2133 | CQQSNSFPYTF | 2157 |
| 009S-B08 | LRP6e3e4 | FTFSSAVQ | 1589 | GWINAGNGN TTYA | 1772 | CARRGGDVTVPAAY YAMDVW | 1963 | RASQSISSYLN | 2094 | ZASSLQS | 2137 | CQQSYSTPLTF | 2174 |
| 010S-A12 | LRP6e3e4 | VTFSRYPIS | 1667 | GGIIPIFGTAN YA | 1749 | CAKDSGNYGYYGMD VW | 1854 | RASQSISSYLN | 2094 | AASSLQS | 2110 | CQQSYSTPLTF | 2174 |
| 010S-B12 | LRP6e3e4 | FTFSSYDMH | 1578 | SGTTSNGGATY YA | 1798 | CARGTTGKGYYYYG MDVW | 1949 | RASQSISSYLN | 2094 | AASSLQS | 2110 | CQQSYSTPLTF | 2174 |

TABLE 2A-continued

Anti-LRP5/6 Antibody Clone IDs and CDR sequences.

| Clone ID | Confirmed Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 010S-C12 | LRP6e3e4 | FTFSNYWIH | 1571 | SAIGTGGGTYYA | 1781 | CTTAGYKAARRSVYPRIFNFDYW | 2044 | RASQSISSYLN | 2094 | AASSLQS | 2110 | CQQSYSTPLTF | 2174 |
| 010S-D12 | LRP6e3e4 | YTFTYRYLH | 1681 | GRIIPIFGTANYA | 1763 | CAREEGVGGMDVW | 1917 | PRSQSIGSWLA | 2100 | DASNLQS | 2116 | CQQSSSTPYTF | 2158 |
| 010S-E12 | LRP6e3e4 | FTFSSYAMH | 1576 | SAIGAGGGTYA | 1779 | CARGVSSGYYYYGMDVW | 1950 | RASQSISSYLN | 2094 | AASSLQS | 2110 | CQQSYSTPLTF | 2174 |
| 010S-F12 | LRP6e3e4 | FTVSSNYMS | 1592 | SAIGTGGGTYYA | 1781 | CARAGTNWGGWYFDLW | 1879 | RASQGISRDLA | 2085 | AASTLQS | 2113 | CQQSYSPPPTF | 2172 |
| 010S-G12 | LRP6e3e4 | FALSGYYMS | 1550 | SSISSSSTYIRYA | 1803 | CATVTGYSSAGAFDIW | 1995 | RASQSISSYLN | 2094 | AASSLQS | 2110 | CQQSYSTPLTF | 2174 |
| 011S-A01 | LRP6e3e4 | FTFSTHAFH | 1583 | SAIRGSGERTYA | 1784 | CARDLRNWGSPYWYFDLW | 1901 | RASQSISSYLN | 2094 | AASSLQS | 2110 | CQQSYSTPLTF | 2174 |
| 011S-B01 | LRP6e3e4 | GTFSHYTIS | 1600 | GWINAGNGNTKYS | 1771 | CAKGGSLDMDVW | 1864 | RASQGISNYLA | 2083 | AASSLHS | 2108 | CQQSYRTPLTF | 2164 |
| 011S-C01 | LRP6e3e4 | LTFTSHGMS | 1615 | SYVDSGSSVYYA | 1818 | CARHPGSFGGYSYAWYYYGMDVW | 1957 | RASQSISSYLN | 2094 | AASSLQS | 2110 | CQQSYSTPLTF | 2174 |
| 011S-D01 | LRP6e3e4 | GTISDYTVS | 1605 | GIINPSGGSTSYA | 1761 | CARGYYDFDYW | 1953 | RASQGISNYLA | 2083 | AASSLQS | 2110 | CQQSYSTPLTF | 2174 |
| 009S-C08 | LRP6e3e4 | FSFNTFGIH | 1556 | AVISVDGSNKYYA | 1738 | CAKSIAAAGTGYYGMDVW | 1869 | RASQSISSYLN | 2094 | AASSLQS | 2110 | CQQSYSTPLTF | 2174 |
| 011S-E01 | LRP6e3e4 | FPFZYYSMN | 1552 | SAISGRDGRTYA | 1785 | CAKDLGIQLPDYYFDYW | 1847 | RASQGISSALA | 2086 | AASTLQS | 2113 | CQQSYSPPPTF | 2173 |
| 011S-D08 | LRP6e3e4 | YTFTSYDIN | 1679 | GGIIPIFGTANYA | 1749 | CARGPYYFDYW | 1941 | RASQGISNNLN | 2082 | DASSLES | 2120 | CLQHNSYPFTF | 2143 |
| 011S-F01 | LRP6e3e4 | FSFSDYYMS | 1558 | SGISESGGRTYA | 1790 | CASAADFDYW | 1967 | RASQDISNYLN | 2079 | AASSLQS | 2110 | CLQDYSYPRTF | 2141 |
| 009S-E08 | LRP6e3e4 | YGFTGYYIH | 1668 | GWMNPNSGNTGYA | 1776 | CARGYGDYDLW | 1952 | QASQDISNYLN | 2077 | DASSLES | 2120 | CQQSYRYPTF | 2165 |
| 009S-F08 | LRP6e3e4 | DTFANYGFS | 1547 | GXVNAGNGNTTYA | 1777 | CAKGWLDFDYW | 1867 | QASQDISNYLN | 2077 | DASSLES | 2120 | CQQSYSTSITF | 2177 |
| 011S-G01 | LRP6e3e4 | YTFTYRYLH | 1681 | GGIIPLFGTANYA | 1750 | CTTDDYGDQYGMDVW | 2046 | RASQSISSYLN | 2094 | AASSLQS | 2110 | CQQSYSTPLTF | 2174 |

TABLE 2A-continued

Anti-LRP5/6 Antibody Clone IDs and CDR sequences.

| Clone ID | Confirmed Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 011S-H01 | LRP6e3e4 | YTFTYRYLH | 1681 | GGIIPIFGTANYA | 1749 | CTTDDYGDLTHLDYW | 2045 | RASQSISSYLN | 2094 | AASSLQS | 2110 | CQQSYSTPLTF | 2174 |
| 011S-A02 | LRP6e3e4 | GTFSSYAIS | 1603 | GWMNPNSGNTGYA | 1776 | CARDKGYAFDIW | 1896 | RSSQSLLHSNGYNYLD | 2102 | AASSLQS | 2110 | CMQALQTITF | 2145 |
| 011S-B02 | LRP6e3e4 | YSFTRTDMH | 1670 | GYISAYTGHTSYA | 1778 | CARDLGTADYW | 1899 | RZSQSZSZYLN | 2104 | AASSLQS | 2110 | CQQSYSTPLTF | 2174 |
| 011S-C02 | LRP6e3e4 | FTFSTSYSMN | 1585 | SGISWNSGRIGYA | 1795 | CARDVGAFDIW | 1906 | QASQDISNYLN | 2077 | AASILQS | 2107 | CQQSYSIPPTF | 2169 |
| 009S-G08 | LRP6e3e4 | FTFSDFAMT | 1566 | SYISGDSGYTNYA | 1813 | CARLGSYPGPYYYMDVW | 1962 | RASQSISSYLN | 2094 | AASSLQS | 2110 | CQQSYSTPLTF | 2174 |
| 011S-D02 | LRP6e3e4 | FTFSSYAMS | 1577 | SSISGSGGVTYYA | 1801 | CARGGNTYYYYGMDVW | 1928 | RASQSISSYLN | 2094 | AASSLQS | 2110 | CQQSYSTPLTF | 2174 |
| 009S-H08 | LRP6e3e4 | YTFTDYFMN | 1673 | GIINPSGDSTRFA | 1758 | CARDGLGGMDVW | 1889 | QASQDISNYLA | 2076 | AASSLQS | 2110 | CQQSYSTPLTF | 2174 |
| 011S-E02 | LRP6e3e4 | YTFTYRYLH | 1681 | GGIIPIFGTANYA | 1749 | CATDYGDYYYGMDVW | 1984 | RASQSISSYLN | 2094 | AASSLQS | 2110 | CQQSYSTPLTF | 2174 |
| 009S-A09 | LRP6e3e4 | YTFTYRYLH | 1681 | GRIPILGSTNYA | 1767 | CTTDLWDYW | 2048 | QASQGITNYLN | 2078 | AASSLQS | 2110 | CLQDYTDPFTF | 2142 |
| 011S-F02 | LRP6e3e4 | FTFSTYGMH | 1584 | SSISVSSGTTHYA | 1805 | CARGGSGSYYYAFDIW | 1930 | RASQSISSYLN | 2094 | AASSLQS | 2110 | CQQSYSTPLTF | 2174 |
| 011S-G02 | LRP6e3e4 | YTFTSYAMN | 1678 | GGIIPIFGTANYA | 1749 | CARDASGGSTGWYYFDSW | 1887 | RASQSISSYLA | 2087 | AASSLQS | 2110 | CQQAYSFPWTF | 2150 |
| 011S-H02 | LRP6e3e4 | YTFTNNFMH | 1676 | GIINPSGGSTSYA | 1761 | CARGLYKRYSYGYGMDVW | 1935 | RASQSISSYLN | 2094 | AASSLQS | 2110 | CQQSYSTPLTF | 2174 |
| 009S-B09 | LRP6e3e4 | FSFNTYAMN | 1557 | AVTSYDGGKKNYA | 1742 | CARDAGGDYDYW | 1885 | QASQDISNYLN | 2077 | AASSLQS | 2110 | CQQSYNTPRTF | 2161 |
| 009S-C09 | LRP6e3e4 | GTFHTYGLS | 1597 | GGIIPIFGTANYA | 1749 | CARGSGWSGLDYW | 1945 | QASQDISNYLN | 2077 | DASNLET | 2115 | CQQSYTTPFTF | 2180 |
| 011S-A03 | LRP6e3e4 | FTFSSYWMH | 1580 | STISGSGGRTYYA | 1808 | CATSPYGVFTLDYW | 1994 | RASQSISSYLN | 2094 | AASSLQS | 2110 | CQQSYSTPLTF | 2174 |
| 011S-B03 | LRP6e3e4 | GTFSZYAIS | 1604 | GIINPSGGSTNYA | 1760 | CARAGYWSGYGYYGMDVW | 1881 | RASQSISSYLN | 2094 | AASSLQS | 2110 | CQQSYSTPLTF | 2174 |

TABLE 2A-continued

Anti-LRP5/6 Antibody Clone IDs and CDR sequences.

| Clone ID | Confirmed Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 011S-C03 | LRP6e3e4 | YTFSYRYLH | 1672 | GGIIPIFGTAN YA | 1749 | CASTVTTDAFDIW | 1978 | QASQDISNY LN | 2077 | DASSLES | 2120 | CQQSYSPPPFTF | 2168 |
| 011S-D03 | LRP6e3e4 | FSFDDYGMS | 1554 | SVISSGGTIYYA | 1812 | CARHLSSGVLSYYGM DVW | 1955 | RASQSISSYLA | 2093 | AASTLQS | 2113 | CQQSYSTPLTF | 2174 |
| 009S-F09 | LRP6e3e4 | YSFTRTDMH | 1670 | GYISAYTGHTS YA | 1778 | CARDLGTADYW | 1900 | RASQSISSYLN | 2094 | AASSLQS | 2110 | CQQSYSTPLTF | 2174 |
| 011S-E03 | LRP6e3e4 | FTFSSYAMS | 1577 | SAISGSGGSTY YA | 1786 | CAKGGRDGYKGYFD YW | 1861 | KSSHSLLSTS TNRNQLA | 2070 | WASSRKS | 2135 | CQQYNNWPY TF | 2186 |
| 011S-G09 | LRP6e3e4 | FTFSRHSMN | 1572 | SYSSGNSGYT NYA | 1817 | CARGDLEFDYW | 1923 | RASQGISNY LA | 2083 | SASSLQS | 2132 | CQQGYNTPRTF | 2154 |
| 011S-F03 | LRP6e3e4 | FTFSSYAMS | 1577 | SAISGSGGSTY YA | 1786 | CAKGGRDGYKGYFD YW | 1862 | KSSQVLYTT TNRNHIA | 2074 | WASSRKS | 2135 | CQQYSTPYTF | 2189 |
| 009S-H09 | LRP6e3e4 | FTFSSYAMS | 1577 | SAISGSGGSTY YA | 1786 | CAKGGRDGYKGYFD YW | 1863 | KSSHSLLSTS TNRNHLA | 2069 | WASSRKS | 2135 | CQQANSLFTF | 2149 |
| 011S-G03 | LRP6e3e4 | YTFTYRYLH | 1681 | GRIIPIHGIANYA | 1764 | CAREYSYGYPRYW | 1922 | RASQSISSYLA | 2087 | DASNLET | 2115 | CQQAYSFPWTF | 2150 |
| 009S-A10 | LRP6e3e4 | FTFTSSAMQ | 1588 | GIINPSGGSTIYA | 1759 | CASGDTYDLYSLDVW | 1970 | RASQSISRW LA | 2091 | AASSLQS | 2110 | CQQSYSTPLTF | 2174 |
| 009S-B10 | LRP6e3e4 | YIFTDYYMH | 1669 | GWINAGNGN TTYA | 1772 | CAKVASGWSWPPDIW | 1871 | RASQSISSYLN | 2094 | AASSLQS | 2110 | CQQSYSTPLTF | 2174 |
| 011S-B04 | LRP6e1e2 | YTFTSYDIN | 1679 | GIINPSGGSTS YA | 1761 | CTREHSYYYYGMDVW | 2042 | RASQSISSYLN | 2094 | AASSLQS | 2110 | CQQSYSTPLTF | 2174 |
| 011S-C04 | LRP6e1e2 | GTFNSNAIS | 1598 | GWMNPNSG NTGYA | 1776 | CARDYYGSGSYNYG MDVW | 1913 | GASQSVPR NSLA | 2066 | GASQRAT | 2124 | CQQYHNWPP EYTF | 2184 |
| 011S-D04 | LRP6e1e2 | YTFTSYDIN | 1679 | GIINPSGGSTS YA | 1761 | CAREAYYYYGMDVW | 1916 | RASQSISSYLN | 2094 | AASSLQS | 2110 | CQQSYSTPLTF | 2174 |

TABLE 2A-continued

Anti-LRP5/6 Antibody Clone IDs and CDR sequences.

| Clone ID | Confirmed Binding | CDRH1 | CDRH1 SEQ ID | CDRH2 | CDRH2 SEQ ID | CDRH3 | CDRH3 SEQ ID | CDRL1 | CDRL1 SEQ ID | CDRL2 | CDRL2 SEQ ID | CDRL3 | CDRL3 SEQ ID |
|---|---|---|---|---|---|---|---|---|---|---|---|---|---|
| 011S-E04 | LRP6e1e2 | FTFSSZZMH | 1581 | SAIGTGGGTZYA | 1782 | CAKDLGRAAAGSMDVW | 1850 | WASQSVRGNYVA | 2106 | DASNRAA | 2117 | CQHRSNWPLTF | 2147 |
| 011S-F04 | LRP6e1e2 | YIFTDYYMH | 1669 | GRIIPILGRANYA | 1765 | CARGGYSTLDYW | 1933 | HGSQDISNYLN | 2067 | DASNRQS | 2119 | CQQSFSTPRTF | 2156 |
| 011S-H04 | LRP6e1e2 | YIFTDYYMH | 1669 | GRIIPILGRANYA | 1765 | CARGGYSTLDYW | 1934 | QASQDISNYLN | 2077 | AASTLQS | 2113 | CQQSFSTPRTF | 2156 |
| 011S-A05 | LRP6e1e2 | FTFSSYAMH | 1576 | SAIGTGGGTYYA | 1781 | CAKDLGRAAAGSMDVW | 1848 | WASQSVRGNYVA | 2106 | DASNRAG | 2118 | CQHRSNWPLTF | 2147 |
| 011S-B05 | LRP6e1e2 | YZFTDYYMH | 1683 | GWMNPNSGNTGYA | 1776 | CTRVAWGLDYW | 2043 | RASQSISSYLN | 2094 | AASSLQS | 2110 | CQQSYSTPLTF | 2174 |
| 011S-C05 | LRP6e1e2 | FTFSSYAMH | 1576 | SAIGTGGGTYYA | 1781 | CAKDLGRAAAGSMDVW | 1849 | WASQSVRGNYVA | 2106 | DASNRAA | 2117 | CQHRSNWPLTF | 2147 |
| 1115.3 | LRP6e1e2 | GPSFSTS | | NLNGGS | | ELAGYGTPFAY | | KASQSISYNLH | | YTSQSIS | | QQSNWPLT | |
| 421.1 | LRP6e1e2 | GYTFTTY | | FPGNVNT | | EELQYYFDY | | SANSSVRFMF | | FTSNLAS | | QQYHSYPWT | |
| YW211.31.57 | LRP6e3e4 | GFTFTSY | | SPYSGS | | RARPPIRLHPRGSVMDY | | RASQDVSTAVA | | SASFLYS | | QQSYTTPPT | |

TABLE 2B

Anti-LRP5/6 Antibody Clone IDs, Heavy Chain (HC) Seq ID Nos, and Binding Characteristics.

| Clone ID | HC Seq ID NO | Confirmed Binding |
|---|---|---|
| 001S-F11 | 66 | LRP6e1e2 |
| 009S-G02 | 67 | LRP6e1e2 |
| 009S-A03 | 68 | LRP6e1e2 |
| 009S-D03 | 69 | LRP6e1e2 |
| 009S-F03 | 70 | LRP6e1e2 |
| 009S-H03 | 71 | LRP6e1e2 |
| 009S-A04 | 72 | LRP6e1e2 |
| 009S-B04 | 73 | LRP6e3e4 |
| 009S-D04 | 74 | LRP6e3e4 |
| 009S-E04 | 75 | LRP6e3e4 |
| 009S-F04 | 76 | LRP6e3e4 |
| 009S-G04 | 77 | LRP6e3e4 |
| 009S-H04 | 78 | LRP6e3e4 |
| 009S-A05 | 79 | LRP6e3e4 |
| 013S-G04 | 80 | LRP6e3e4 |
| 013S-H04 | 81 | LRP6e3e4 |
| 013S-C05 | 82 | LRP6e3e4 |
| 013S-D05 | 83 | LRP6e3e4 |
| 013S-G04 | 84 | LRP6e3e4 |
| 013S-H04 | 85 | LRP6e3e4 |
| 013S-A05 | 86 | LRP6e3e4 |
| 013S-C05 | 87 | LRP6e3e4 |
| 013S-D05 | 88 | LRP6e3e4 |
| 008S-D01 | 133 | LRP5 |

In certain embodiment, the LRP5/6 binding domain may be selected from any binding domain that binds LRP5 or LRP6 with a $K_D$ of less than or equal to about $1 \times 10^{-4}$ M, less than or equal to about $1 \times 10^{-5}$ M, less than or equal to about $1 \times 10^{-6}$ M, less than or equal to about $1 \times 10^{-7}$ M, less than or equal to about $1 \times 10^{-8}$ M, less than or equal to about $1 \times 10^{-9}$ M, or less than or equal to about $1 \times 10^{-10}$ M in the context of a Wnt surrogate molecule. In certain embodiment, the LRP5/6 binding domain may be selected from any binding domain that binds LRP5 or LRP6 with a $K_D$ of greater than or equal to about $1 \times 10^{-4}$ M, greater than or equal to about $1 \times 10^{-5}$ M, greater than or equal to about $1 \times 10^{-6}$ M, greater than or equal to about $1 \times 10^{-7}$ M, greater than or equal to about $1 \times 10^{-8}$ M, greater than or equal to about $1 \times 10^{-9}$ M, or greater than about $1 \times 10^{-10}$ M in the context of a Wnt surrogate molecule. In certain embodiment, the LRP5/6 binding domain may be selected from any binding domain that binds LRP5 or LRP6 at high affinity, e.g. a $K_D$ of less than about $1 \times 10^{-7}$ M, less than about $1 \times 10^{-8}$ M, less than about $1 \times 10^{-9}$ M, or less than about $1 \times 10^{-10}$ M.

Other suitable LRP5/6 binding domains include, without limitation, de novo designed LRP5/6 binding proteins, antibody derived binding proteins, e.g. scFv, Fab, etc. and other portions of antibodies that specifically bind to one or more Fzd proteins; VHH or sdAb derived binding domains; knottin-based engineered scaffolds; naturally occurring LRP5/6, including without limitation, DKK1, DKK2, DKK3, DKK4, sclerostin; Wise; fusions proteins comprising any of the above; derivatives of any of the above; variants of any of the above; and biologically active fragments of any of the above, and the like. A LRP5/6 binding domain may be affinity selected to enhance binding.

Members of the Dickkopf (DKK) gene family (see Krupnik et al. (1999) Gene 238(2):301-13) include DKK-1, DKK-2, DKK-3, and DKK-4, and the DKK-3 related protein Soggy (Sgy). hDKKs 1-4 contain two distinct cysteine-rich domains in which the positions of 10 cysteine residues are highly conserved between family members. Exemplary sequences of human Dkk genes and proteins are publicly available, e.g., Genbank accession number NM_014419 (soggy-1); NM_014420 (DKK4); AF177394 (DKK-1); AF177395 (DKK-2); NM_015881 (DKK3); and NM_014421 (DKK2). In some embodiments of the invention, the Lrp6 binding moiety is a DKK1 peptide, including without limitation the C-terminal domain of human DKK1. The C-terminal domain may comprise the sequence:

(SEQ ID NO: 2190)
KMYHTKGQEGSVCLRSSDCASGLCCARHFWSKICKPVLKEGQVCTKH

RRKGSHGLEIFQRCYCGEGLSCRIQKDHHQASNSSRLHTCQRH (see Genbank accession number NP_036374) or a biologically active fragment thereof.

Binding of DKK proteins to LRP5/6 are discussed, for example in Brott and Sokol Mol. Cell. Biol. 22 (17), 6100-6110 (2002); and Li et al. J. Biol. Chem. 277 (8), 5977-5981 (2002), each herein specifically incorporated by reference. The corresponding region of human DKK2 (Genbank reference NP_055236) may comprise the sequence: KMSHIKGHEGDPCLRSSDCIEGFCCARHFWTKICKPVLHQGEVCTKQRKKGSH GLEIFQRCD-CAKGLSCKVWKDATYSSKARLHVCQK (SEQ ID NO:2191) or a biologically active fragment thereof.

Antibodies that specifically bind to LRP5 or LRP6 are known in the art and are commercially available, or can be generated de novo. LRP5, LRP6 or fragments thereof can be used as an immunogen or in screening assays to develop an antibody. Examples of known antibodies include, without limitation, those described in Gong et al. (2010) PLoS One. 5(9):e12682; Ettenberg et al. (2010) Proc Natl Acad Sci USA. 107(35):15473-8; and those commercially available from, for example Santa Cruz biotechnology antibody clone 1A12, which was raised against synthetic LRP5/6 of human origin and binds to both the full length and proteolytic fragment of LRP6 and LRP5 of mouse and human origin; the monoclonal antibody 2611; Cell Signaling Technology antibody specific for LRP5 (D80F2), catalog number 5731; etc.

In certain embodiments, Wnt surrogate molecules disclosed herein comprise one or more polypeptides comprising two or more binding regions. For example, the two or more binding regions may be two or more Fzd binding regions or two or more LRP5/6 binding regions, or they may comprise one or more Fzd binding region and one or more LRP5/6 binding region. The binding regions may be directly joined or contiguous, or may be separated by a linker, e.g. a polypeptide linker, or a non-peptidic linker, etc. The length of the linker, and therefore the spacing between the binding domains can be used to modulate the signal strength, and can be selected depending on the desired use of the Wnt surrogate molecule. The enforced distance between binding domains can vary, but in certain embodiments may be less than about 100 angstroms, less than about 90 angstroms, less than about 80 angstroms, less than about 70 angstroms, less than about 60 angstroms, or less than about 50 angstroms. In some embodiments the linker is a rigid linker, in other embodiments the linker is a flexible linker. In certain embodiments where the linker is a peptide linker, it may be from about 1, 2, 3, 4, 5, 6, 7, 8, 9, 10, 11, 12, 13, 14, 15, 16, 17, 18, 19, 20 21, 22, 23, 24, 25, 26, 27, 28, 29, 30 or more amino acids in length, and is of sufficient length and amino acid composition to enforce the distance between binding domains. In some embodiments, the linker comprises or consists of one or more glycine and/or serine residues.

In particular embodiments, a Wnt surrogate molecule comprises a polypeptide sequence having at least 90%, at least 95%, at least 98% or at least 99% identity to a polypeptide sequence disclosed in any of SEQ ID NOs:89-128 or 134-157, or having at least 90%, at least 95%, at least 98% or at least 99% identity to an antigen-binding fragment of a polypeptide sequence disclosed in any of SEQ ID NOs:89-128 or 134-157. In certain embodiments, the Wnt surrogate molecules comprises or consists of a polypeptide sequence set forth in any of SEQ ID NOs:89-128 or 134-157, or an antigen-binding fragment thereof. In particular embodiments, the antigen-binding fragment binds one or more Fzd receptors and also binds LRP5 and/or LRP6.

Wnt surrogate molecule can be multimerized, e.g. through an Fc domain, by concatenation, coiled coils, polypeptide zippers, biotin/avidin or streptavidin multimerization, and the like. The Wnt surrogate molecules can also be joined to a moiety such as PEG, Fc, etc., as known in the art to enhance stability in vivo.

In certain embodiments, a Wnt surrogate molecule directly activates canonical Wnt signaling through binding to one or more Fzd proteins and to LRP5/6, particularly by binding to these proteins on a cell surface, e.g., the surface of a human cell. The direct activation of Wnt signaling by a Wnt surrogate molecule is in contrast to potentiation of Writ signaling, which enhances activity only when native Wnt proteins are present.

Wnt surrogate molecules may activate Wnt signaling, e.g., by mimicking the effect or activity of a Wnt protein binding to a frizzled protein. The ability of the Wnt surrogate molecules of the invention to mimic the activity of Wnt can be confirmed by a number of assays. The Wnt surrogate molecules typically initiate a reaction or activity that is similar to or the same as that initiated by the receptor's natural ligand. In particular, the Wnt surrogate molecules of the invention enhance the canonical Wnt/β-catenin signaling pathway. As used herein, the term "enhances" refers to a measurable increase in the level of Wnt/β-catenin signaling compared with the level in the absence of a Wnt surrogate molecule of the invention.

Various methods are known in the art for measuring the level of canonical Wnt/β-catenin signaling. These include, but are not limited to assays that measure: Wnt/β-catenin target gene expression; TCF reporter gene expression; β-catenin stabilization; LRP phosphorylation; Axin translocation from cytoplasm to cell membrane and binding to LRP. The canonical Wnt/β-catenin signaling pathway ultimately leads to changes in gene expression through the transcription factors TCF7, TCF7L1, TCF7L2 (a.k.a., TCF4), and LEF. The transcriptional response to Wnt activation has been characterized in a number of cells and tissues. As such, global transcriptional profiling by methods well known in the art can be used to assess Wnt/β-catenin signaling activation or inhibition.

Changes in Wnt-responsive gene expression are generally mediated by TCF and LEF transcription factors. A TCF reporter assay assesses changes in the transcription of TCF/LEF controlled genes to determine the level of Wnt/β-catenin signaling. A TCF reporter assay was first described by Korinek, V. et al., 1997. Also known as TOP/FOP this method involves the use of three copies of the optimal TCF motif CCTTTGATC, or three copies of the mutant motif CCTTTGGCC, upstream of a minimal c-Fos promoter driving luciferase expression (pTOPFI_ASH and pFOPFI_ASH, respectively) to determine the transactivational activity of endogenous p-catenin/TCF4. A higher ratio of these two reporter activities (TOP/FOP) indicates higher β-catenin/TCF4 activity, whereas a lower ratio of these two reporter activities indicates lower β-catenin/TCF4 activity.

Various other reporter transgenes that respond to Wnt signals exist intact in animals and therefore, effectively reflect endogenous Wnt signaling. These reporters are based on a multimerized TCF binding site, which drives expression of LacZ or GFP, which are readily detectable by methods known in the art. These reporter genes include: TOP-GAL, BAT-GAL, ins-TOPE FP, ins-TOPGAL, LEF-EGFP, Axin2-LacZ, Axin2-d2EGFP, Lgr5tm1 (cre/ERT2), TOPdGFP.

The recruitment of dephosphorylated β-catenin to the membrane, stabilization and phosphorylation status of β-catenin, and translocation of β-catenin to the nucleus (Klapholz-Brown Z et al., PLoS One. 2(9) e945, 2007), in some cases mediated by complex formation with TCF transcription factors and TNIK are key steps in the Writ signaling pathway. Stabilization is mediated by Disheveled family proteins that inhibit the "destruction" complex so that degradation of intracellular β-catenin is reduced, and translocation of β-catenin to the nucleus follows thereafter. Therefore, measuring the level and location of β-catenin in a cell is a good reflection of the level of Wnt/β-catenin signaling. A non-limiting example of such an assay is the "BioImage β-Catenin Redistribution Assay" (Thermo Scientific) which provides recombinant U2OS cells that stably express human β-catenin fused to the C-terminus of enhanced green fluorescent protein (EGFP). Imaging and analysis is performed with a fluorescence microscope or HCS platform allowing the levels and distribution of EGFP-β-catenin to be visualized.

Another way, in which the destruction complex is inhibited, is by removal of Axin by recruitment of Axin to the cytoplasmic tail of the Wnt co-receptor LRP. Axin has been shown to bind preferentially to a phosphorylated form of the LRP tail. Visualization of Axin translocation, for example with a GFP-Axin fusion protein, is therefore another method for assessing levels of Wnt/β-catenin signaling.

In certain embodiments, a Wnt surrogate molecule enhances or increases canonical Wnt pathway signaling, e.g., β-catenin signaling, by at least 30%, 35%, 40%, 45%, 50%, 60%, 70%, 75%, 80%, 85%, 90%, 95%, 100%, 110%, 150%, 200%, 250%, 300%, 400% or 500%, as compared to the β-catenin signaling induced by a neutral substance or negative control as measured in an assay described above, for example as measured in the TOPFlash assay. A negative control may be included in these assays. In particular embodiments, Wnt surrogate molecules may enhance β-catenin signaling by a factor of 2×, 5×, 10×, 100×, 1000×, 10000× or more as compared to the activity in the absence of the Wnt surrogate molecule when measured in an assay described above, for example when measured in the TOP-Flash assay, or any of the other assays mentioned herein.

"Wnt gene product" or "Wnt polypeptide" when used herein encompass native sequence Writ polypeptides, Wnt polypeptide variants, Wnt polypeptide fragments and chimeric Wnt polypeptides. In particular embodiments, a Wnt polypeptide is a native human full length mature Wnt protein.

For example, human native sequence Wnt proteins of interest in the present application include the following: Wnt-1 (GenBank Accession No. NM_005430); Wnt-2 (GenBank Accession No. NM_003391); Wnt-2B (Wnt-13) (GenBank Accession No. NM_004185 (isoform 1), NM_024494.2 (isoform 2)), Wnt-3 (RefSeq.: NM_030753), Wnt3a (GenBank Accession No. NM_033131), Wnt-4 (GenBank Accession No. NM_030761), Wnt-5A (GenBank Accession No. NM_003392), Wnt-5B (GenBank Accession No. NM_032642), Wnt-6 (GenBank Accession No.

NM_006522), Wnt-7A (GenBank Accession No. NM_004625), Wnt-7B (GenBank Accession No. NM_058238), Wnt-8A (GenBank Accession No. NM_058244), Wnt-8B (GenBank Accession No. NM_003393), Wnt-9A (Wnt-14) (GenBank Accession No. NM_003395), Wnt-9B (Wnt-15) (GenBank Accession No. NM_003396), Wnt-1 OA (GenBank Accession No. NM_025216), Wnt-10B (GenBank Accession No. NM_003394), Wnt-11 (GenBank Accession No. NM_004626), Wnt-16 (GenBank Accession No. NM_016087)). Although each member has varying degrees of sequence identity with the family, all encode small (i.e., 39-46 kD), acylated, palmitoylated, secreted glycoproteins that contain 23-24 conserved cysteine residues whose spacing is highly conserved (McMahon, A P et al., Trends Genet. 1992; 8: 236-242; Miller, J R. Genome Biol. 2002; 3(1): 3001.1-3001.15). Other native sequence Wnt polypeptides of interest include orthologs of the above from any mammal, including domestic and farm animals, and zoo, laboratory or pet animals, such as dogs, cats, cattle, horses, sheep, pigs, goats, rabbits, rats, mice, frogs, zebra fish, fruit fly, worm, etc.

"Wnt pathway signaling" or "Wnt signaling" is used herein to refer to the mechanism by which a biologically active Wnt exerts its effects upon a cell to modulate a cell's activity. Wnt proteins modulate cell activity by binding to Wnt receptors, including proteins from the Frizzled (Fzd) family of proteins, proteins from the ROR family of proteins, the proteins LRP5, LRP6 from the LRP family of proteins, the protein FRL1/crypto, and the protein Derailed/Ryk. Once activated by Wnt binding, the Wnt receptor(s) will activate one or more intracellular signaling cascades. These include the canonical Wnt signaling pathway; the Wnt/planar cell polarity (Wnt/PCP) pathway; the Wnt-calcium (Wnt/Ca$^{2+}$) pathway (Giles, R H et al. (2003) Biochim Biophys Acta 1653, 1-24; Peifer, M. et al. (1994) Development 120: 369-380; Papkoff, J. et al (1996) Mol. Cell Biol. 16: 2128-2134; Veeman, M. T. et al. (2003) Dev. Cell 5: 367-377); and other Writ signaling pathways as is well known in the art.

For example, activation of the canonical Wnt signaling pathway results in the inhibition of phosphorylation of the intracellular protein β-catenin, leading to an accumulation of β-catenin in the cytosol and its subsequent translocation to the nucleus where it interacts with transcription factors, e.g. TCF/LEF, to activate target genes. Activation of the Wnt/PCP pathway activates RhoA, c-Jun N-terminal kinase (JNK), and nemo-like kinase (NLK) signaling cascades to control such biological processes as tissue polarity and cell movement. Activation of the Wnt/Ca$^{2+}$ by, for example, binding of Wnt-4, Wnt-5A or Wnt-11, elicits an intracellular release of calcium ions, which activates calcium sensitive enzymes like protein kinase C (PKC), calcium-calmodulin dependent kinase II (CamKII) or calcineurin (CaCN). By assaying for activity of the above signaling pathways, the biological activity of an antibody or antigen-binding fragment thereof, e.g., a Wnt surrogate molecule, can be readily determined.

In certain embodiments, functional properties of Wnt surrogate molecules may be assessed using a variety of methods known to the skilled person, including e.g., affinity/binding assays (for example, surface plasmon resonance, competitive inhibition assays), cytotoxicity assays, cell viability assays, cell proliferation or differentiation assays in response to a Wnt, cancer cell and/or tumor growth inhibition using in vitro or in vivo models, including but not limited to any described herein. The Wnt surrogate molecules described herein may also be tested for effects on Fzd receptor internalization, in vitro and in vivo efficacy, etc. Such assays may be performed using well-established protocols known to the skilled person (see e.g., Current Protocols in Molecular Biology (Greene Publ. Assoc. Inc. & John Wiley & Sons, Inc., NY, NY); Current Protocols in Immunology (Edited by: John E. Coligan, Ada M. Kruisbeek, David H. Margulies, Ethan M. Shevach, Warren Strober 2001 John Wiley & Sons, NY, NY); or commercially available kits.

In certain embodiments, a Fzd-binding region of a Wnt surrogate molecule (e.g., an antigen-binding fragment of an anti-Fzd antibody) comprises one or more of the CDRs of the anti-Fzd antibodies described herein. In certain embodiments, a LRP5/6-binding region of a Wnt surrogate molecule (e.g., an antigen-binding fragment of an anti-LRP5/6 antibody) comprises one or more of the CDRs of the anti-LRP5/6 antibodies described herein. In this regard, it has been shown in some cases that the transfer of only the VHCDR3 of an antibody can be performed while still retaining desired specific binding (Barbas et al., PNAS (1995) 92: 2529-2533). See also, McLane et al., PNAS (1995) 92:5214-5218, Barbas et al., J. Am. Chem. Soc. (1994) 116:2161-2162.

Also disclosed herein is a method for obtaining an antibody or antigen binding domain specific for a Fzd receptor, the method comprising providing by way of addition, deletion, substitution or insertion of one or more amino acids in the amino acid sequence of a VH domain set out herein or a VH domain which is an amino acid sequence variant of the VH domain, optionally combining the VH domain thus provided with one or more VL domains, and testing the VH domain or VH/VL combination or combinations to identify a specific binding member or an antibody antigen binding domain specific for one or more Fzd receptor and optionally with one or more desired properties. The VL domains may have an amino acid sequence which is substantially as set out herein. An analogous method may be employed in which one or more sequence variants of a VL domain disclosed herein are combined with one or more VH domains.

In particular embodiments, Wnt surrogate molecules are water soluble. By "water soluble" it is meant a composition that is soluble in aqueous buffers in the absence of detergent, usually soluble at a concentration that provides a biologically effective dose of the polypeptide. Compositions that are water soluble form a substantially homogenous composition that has a specific activity that is at least about 5% that of the starting material from which it was purified, usually at least about 10%, 20%, or 30% that of the starting material, more usually about 40%, 50%, or 60% that of the starting material, and may be about 50%, about 90% or greater. Wnt surrogate molecules disclosed herein typically form a substantially homogeneous aqueous solution at concentrations of at least 25 µM and higher, e.g. at least 25 µM, 40 µM, or 50 µM, usually at least 60 µM, 70 µM, 80 µM, or 90 µM, sometimes as much as 100 µM, 120 µM, or 150 µM. In other words, Wnt surrogate molecules disclosed herein typically form a substantially homogeneous aqueous solution at concentrations of about 0.1 mg/ml, about 0.5 mg/ml, of about 1 mg/ml or more.

An antigen or epitope that "specifically binds" or "preferentially binds" (used interchangeably herein) to an antibody or antigen-binding fragment thereof is a term well understood in the art, and methods to determine such specific or preferential binding are also well known in the art. A molecule, e.g., a Wnt surrogate molecule, is said to exhibit "specific binding" or "preferential binding" if it reacts or associates more frequently, more rapidly, with greater duration and/or with greater affinity with a particular cell or substance than it does with alternative cells or substances. A molecule or binding region thereof, e.g., a Wnt surrogate molecule or binding region thereof, "specifically binds" or "preferentially binds" to a target antigen, e.g., a Fzd receptor, if it binds with greater affinity, avidity, more readily, and/or with greater duration than it binds to other substances. For example, a Wnt surrogate molecule or binding region thereof that specifically or preferentially binds to the Fzd1 receptor is an antibody that binds to the Fzd1 receptor with greater affinity, avidity, more readily, and/or with greater duration than it binds to other Fzd receptors or non-Fzd proteins. It is also understood by reading this definition that, for example, a Wnt surrogate molecule or binding region thereof that specifically or preferentially binds to a first target may or may not specifically or preferentially bind to a second target. As such, "specific binding" or "preferential binding" does not necessarily require (although it can include) exclusive binding. Generally, but not necessarily, reference to binding means preferential binding.

In some embodiments, any of the one or more Fzd binding region of a Wnt surrogate molecule binds to one, two, three, four, five or more different frizzled proteins, e.g., one or more of human frizzled proteins Fzd1, Fzd2, Fzd3, Fzd4, Fzd5, Fzd6, Fzd7, Fzd8, Fzd9, Fzd10. In some embodiments, any of the Fzd binding regions binds to Fzd1, Fzd2, Fzd5, Fzd7 and Fzd8. In various embodiments, any of the Fzd binding regions binds to: (i) Fzd1, Fzd2, Fzd7 and Fzd9; (ii) Fzd1, Fzd2 and Fzd7; (iii) Fzd5 and Fzd8; (iv) Fzd5, Fzd7 and Fzd8; (v) Fzd1, Fzd4, Fzd5 and Fzd8; (vi) Fzd1, Fzd2, Fzd5, Fzd7 and Fzd8; (vii) Fzd4 and Fzd9; (viii) Fzd9 and Fzd10; (ix) Fzd5, Fzd8 and Fzd10; or (x) Fzd4, Fzd5 and Fzd8; Fzd1, Fzd5, Fzd7 and Fzd8. In some embodiments, the Fzd binding region is selective for one or more Fzd protein of interest, e.g. having a specificity for the one or more desired Fzd protein of at least 10-fold, 25-fold, 50-fold, 100-fold, 200-fold or more relative to other Fzd proteins. In some embodiments, any of the one or more Fzd binding region of a Wnt surrogate molecule is monospecific and binds or specifically binds to only one of Fzd1, Fzd2, Fzd3, Fzd4, Fzd5, Fzd6, Fzd7, Fzd8, Fzd9, or Fzd10.

In some embodiments, any of the one or more LRP5/6 binding region of a Wnt surrogate molecule binds to one or both of LRP5/6. For convenience, the term "LRP5/6" is used to refer collectively to either or both of LRP5 and/or LRP6.

Immunological binding generally refers to the non-covalent interactions of the type which occur between an immunoglobulin molecule and an antigen for which the immunoglobulin is specific, for example by way of illustration and not limitation, as a result of electrostatic, ionic, hydrophilic and/or hydrophobic attractions or repulsion, steric forces, hydrogen bonding, van der Waals forces, and other interactions. The strength, or affinity of immunological binding interactions can be expressed in terms of the dissociation constant ($K_d$) of the interaction, wherein a smaller $K_d$ represents a greater affinity. Immunological binding properties of selected polypeptides can be quantified using methods well known in the art. One such method entails measuring the rates of antigen-binding site/antigen complex formation and dissociation, wherein those rates depend on the concentrations of the complex partners, the affinity of the interaction, and on geometric parameters that equally influence the rate in both directions. Thus, both the "on rate constant" ($K_{on}$) and the "off rate constant" ($K_{off}$) can be determined by calculation of the concentrations and the actual rates of association and dissociation. The ratio of $K_{off}/K_{on}$ enables cancellation of all parameters not related to affinity, and is thus equal to the dissociation constant $K_d$. See, generally, Davies et al. (1990) *Annual Rev. Biochem.* 59:439-473.

In certain embodiments, the Wnt surrogate molecules or binding regions thereof described herein have an affinity of less than about 10,000, less than about 1000, less than about 100, less than about 10, less than about 1 or less than about 0.1 nM, and in some embodiments, the antibodies may have even higher affinity for one or more Fzd receptor or LRP5 or LRP6 receptor.

The constant regions of immunoglobulins show less sequence diversity than the variable regions, and are responsible for binding a number of natural proteins to elicit important biochemical events. In humans, there are five different classes of antibodies including IgA (which includes subclasses IgA1 and IgA2), IgD, IgE, IgG (which includes subclasses IgG1, IgG2, IgG3, and IgG4), and IgM. The distinguishing features between these antibody classes are their constant regions, although subtler differences may exist in the V region.

The Fc region of an antibody interacts with a number of Fc receptors and ligands, imparting an array of important functional capabilities referred to as effector functions. For IgG, the Fc region comprises Ig domains CH2 and CH3 and the N-terminal hinge leading into CH2. An important family of Fc receptors for the IgG class are the Fc gamma receptors (FcγRs). These receptors mediate communication between antibodies and the cellular arm of the immune system (Raghavan et al., 1996, Annu Rev Cell Dev Biol 12:181-220; Ravetch et al., 2001, Annu Rev Immunol 19:275-290). In humans this protein family includes FcγRI (CD64), including isoforms FcγRIa, FcγRIb, and FcγRIc; FcγRII (CD32), including isoforms FcγRIIa (including allotypes H131 and R131), FcγRIIb (including FcγRIIb-1 and FcγRIIb-2), and FcγRIIc; and FcγRIII (CD16), including isoforms FcγRIIIa (including allotypes V158 and F158) and FcγRIIIb (including allotypes FcγRIIIb-NA1 and FcγRIIIb-NA2) (Jefferis et al., 2002, Immunol Lett 82:57-65). These receptors typically have an extracellular domain that mediates binding to Fc, a membrane spanning region, and an intracellular domain that may mediate some signaling event within the cell. These receptors are expressed in a variety of immune cells including monocytes, macrophages, neutrophils, dendritic cells, eosinophils, mast cells, platelets, B cells, large granular lymphocytes, Langerhans' cells, natural killer (NK) cells, and T cells. Formation of the Fc/FcγR complex recruits these effector cells to sites of bound antigen, typically resulting in signaling events within the cells and important subsequent immune responses such as release of inflammation mediators, B cell activation, endocytosis, phagocytosis, and cytotoxic attack.

The ability to mediate cytotoxic and phagocytic effector functions is a potential mechanism by which antibodies destroy targeted cells. The cell-mediated reaction wherein nonspecific cytotoxic cells that express FcγRs recognize bound antibody on a target cell and subsequently cause lysis of the target cell is referred to as antibody dependent cell-mediated cytotoxicity (ADCC) (Raghavan et al., 1996, Annu Rev Cell Dev Biol 12:181-220; Ghetie et al., 2000, Annu Rev Immunol 18:739-766; Ravetch et al., 2001, Annu Rev Immunol 19:275-290). The cell-mediated reaction wherein nonspecific cytotoxic cells that express FcγRs recognize bound antibody on a target cell and subsequently cause phagocytosis of the target cell is referred to as antibody dependent cell-mediated phagocytosis (ADCP).

All FcγRs bind the same region on Fc, at the N-terminal end of the Cg2 (CH2) domain and the preceding hinge. This interaction is well characterized structurally (Sondermann et al., 2001, J Mol Biol 309:737-749), and several structures of the human Fc bound to the extracellular domain of human FcγRIIIb have been solved (pdb accession code 1E4K) (Sondermann et al., 2000, Nature 406:267-273.) (pdb accession codes 11 IIS and 11 IX) (Radaev et al., 2001, J Biol Chem 276:16469-16477.)

The different IgG subclasses have different affinities for the FcγRs, with IgG1 and IgG3 typically binding substantially better to the receptors than IgG2 and IgG4 (Jefferis et al., 2002, Immunol Lett 82:57-65). All FcγRs bind the same region on IgG Fc, yet with different affinities: the high affinity binder FcγRI has a $K_d$ for IgG1 of $10^{-8}$ $M^{-1}$, whereas the low affinity receptors FcγRII and FcγRIII generally bind at $10^{-6}$ and $10^{-5}$ respectively. The extracellular domains of FcγRIIIa and FcγRIIIb are 96% identical; however, FcγRIIIb does not have an intracellular signaling domain. Furthermore, whereas FcγRI, FcγRIIa/c, and FcγRIIIa are positive regulators of immune complex-triggered activation, characterized by having an intracellular domain that has an immunoreceptor tyrosine-based activation motif (ITAM), FcγRIIb has an immunoreceptor tyrosine-based inhibition motif (ITIM) and is therefore inhibitory. Thus the former are referred to as activation receptors, and FcγRIIb is referred to as an inhibitory receptor. The receptors also differ in expression pattern and levels on different immune cells. Yet another level of complexity is the existence of a number of FcγR polymorphisms in the human proteome. A particularly relevant polymorphism with clinical significance is V158/F158 FcγRIIIa. Human IgG1 binds with greater affinity to the V158 allotype than to the F158 allotype. This difference in affinity, and presumably its effect on ADCC and/or ADCP, has been shown to be a significant determinant of the efficacy of the anti-CD20 antibody rituximab (Rituxan®, a registered trademark of IDEC Pharmaceuticals Corporation). Subjects with the V158 allotype respond favorably to rituximab treatment; however, subjects with the lower affinity F158 allotype respond poorly (Cartron et al., 2002, Blood 99:754-758). Approximately 10-20% of humans are V158/V158 homozygous, 45% are V158/F158 heterozygous, and 35-45% of humans are F158/F158 homozygous (Lehrbecher et al., 1999, Blood 94:4220-4232; Cartron et al., 2002, Blood 99:754-758). Thus 80-90% of humans are poor responders, that is, they have at least one allele of the F158 FcγRIIIa.

The Fc region is also involved in activation of the complement cascade. In the classical complement pathway, C1 binds with its C1q subunits to Fc fragments of IgG or IgM, which has formed a complex with antigen(s). In certain embodiments of the invention, modifications to the Fc region comprise modifications that alter (either enhance or decrease) the ability of a Fzd-specific antibody as described herein to activate the complement system (see e.g., U.S. Pat. No. 7,740,847). To assess complement activation, a complement-dependent cytotoxicity (CDC) assay may be performed (See, e.g., Gazzano-Santoro et al., J. Immunol. Methods, 202:163 (1996)).

Thus in certain embodiments, the present invention provides anti-Fzd antibodies having a modified Fc region with altered functional properties, such as reduced or enhanced CDC, ADCC, or ADCP activity, or enhanced binding affinity for a specific FcγR or increased serum half-life. Other modified Fc regions contemplated herein are described, for example, in issued U.S. Pat. Nos. 7,317,091; 7,657,380; 7,662,925; 6,538,124; 6,528,624; 7,297,775; 7,364,731; Published U.S. Applications US2009092599; US20080131435; US20080138344; and published International Applications WO2006/105338; WO2004/063351; WO2006/088494; WO2007/024249.

In certain embodiments, Wnt surrogate molecules comprise antibody variable domains with the desired binding specificities fused to immunoglobulin constant domain sequences. In certain embodiments, the fusion is with an Ig heavy chain constant domain, comprising at least part of the hinge, $C_H2$, and $C_H3$ regions. In particular embodiments, the first heavy-chain constant region ($C_H1$) containing the site necessary for light chain bonding, present in at least one of the fusions. DNAs encoding the immunoglobulin heavy chain fusions and, if desired, the immunoglobulin light chain, are inserted into separate expression vectors, and are co-transfected into a suitable host cell. This provides for greater flexibility in adjusting the mutual proportions of the three polypeptide fragments in embodiments when unequal ratios of the three polypeptide chains used in the construction provide the optimum yield of the desired bispecific antibody. It is, however, possible to insert the coding sequences for two or all three polypeptide chains into a single expression vector when the expression of at least two polypeptide chains in equal ratios results in high yields or when the ratios have no significant effect on the yield of the desired chain combination.

Wnt surrogate molecules disclosed herein may also be modified to include an epitope tag or label, e.g., for use in purification or diagnostic applications. There are many linking groups known in the art for making antibody conjugates, including, for example, those disclosed in U.S. Pat. No. 5,208,020 or EP Patent 0 425 235 B1, and Chari et al., Cancer Research 52: 127-131 (1992). The linking groups include disulfide groups, thioether groups, acid labile groups, photolabile groups, peptidase labile groups, or esterase labile groups, as disclosed in the above-identified patents, disulfide and thioether groups being preferred.

In certain embodiments, anti-LRP5/6 antibodies and antigen-binding fragments thereof and/or anti-Fzd antibodies and antigen-binding fragments thereof present within a Wnt surrogate molecule are monoclonal. In certain embodiments, they are humanized.

The present invention further provides in certain embodiments an isolated nucleic acid encoding a polypeptide present in a Wnt surrogate molecule disclosed herein. Nucleic acids include DNA and RNA. These and related embodiments may include polynucleotides encoding antibody fragments that bind one or more Fzd receptors and/or LRP5 or LRP6 as described herein. The term "isolated polynucleotide" as used herein shall mean a polynucleotide of genomic, cDNA, or synthetic origin, or some combination thereof, which by virtue of its origin, the isolated polynucleotide: (1) is not associated with all or a portion of a polynucleotide in which the isolated polynucleotide is found in nature; (2) is linked to a polynucleotide to which it is not linked in nature, or (3) does not occur in nature as part of a larger sequence. An isolated polynucleotide may include naturally occurring and/or artificial sequences.

The term "operably linked" means that the components to which the term is applied are in a relationship that allows them to carry out their inherent functions under suitable conditions. For example, a transcription control sequence "operably linked" to a protein coding sequence is ligated thereto so that expression of the protein coding sequence is achieved under conditions compatible with the transcriptional activity of the control sequences.

The term "control sequence" as used herein refers to polynucleotide sequences that can affect expression, processing or intracellular localization of coding sequences to which they are ligated or operably linked. The nature of such control sequences may depend upon the host organism. In particular embodiments, transcription control sequences for prokaryotes may include a promoter, ribosomal binding site, and transcription termination sequence. In other particular embodiments, transcription control sequences for eukaryotes may include promoters comprising one or a plurality of recognition sites for transcription factors, transcription enhancer sequences, transcription termination sequences and polyadenylation sequences. In certain embodiments, "control sequences" can include leader sequences and/or fusion partner sequences.

The term "polynucleotide" as referred to herein means single-stranded or double-stranded nucleic acid polymers. In certain embodiments, the nucleotides comprising the polynucleotide can be ribonucleotides or deoxyribonucleotides or a modified form of either type of nucleotide. Said modifications include base modifications such as bromouridine, ribose modifications such as arabinoside and 2',3'-dideoxyribose and internucleotide linkage modifications such as phosphorothioate, phosphorodithioate, phosphoroselenoate, phosphorodiselenoate, phosphoroanilothioate, phoshoraniladate and phosphoroamidate. The term "polynucleotide" specifically includes single and double stranded forms of DNA.

The term "naturally occurring nucleotides" includes deoxyribonucleotides and ribonucleotides. The term "modified nucleotides" includes nucleotides with modified or substituted sugar groups and the like. The term "oligonucleotide linkages" includes oligonucleotide linkages such as phosphorothioate, phosphorodithioate, phosphoroselenoate, phosphorodiselenoate, phosphoroanilothioate, phoshoraniladate, phosphoroamidate, and the like. See, e.g., LaPlanche et al., 1986, Nucl. Acids Res., 14:9081; Stec et al., 1984, J. Am. Chem. Soc., 106:6077; Stein et al., 1988, Nucl. Acids Res., 16:3209; Zon et al., 1991, Anti-Cancer Drug Design, 6:539; Zon et al., 1991, OLIGONUCLEOTIDES AND ANALOGUES: A PRACTICAL APPROACH, pp. 87-108 (F. Eckstein, Ed.), Oxford University Press, Oxford England; Stec et al., U.S. Pat. No. 5,151,510; Uhlmann and Peyman, 1990, Chemical Reviews, 90:543, the disclosures of which are hereby incorporated by reference for any purpose. An oligonucleotide can include a detectable label to enable detection of the oligonucleotide or hybridization thereof.

The term "vector" is used to refer to any molecule (e.g., nucleic acid, plasmid, or virus) used to transfer coding information to a host cell. The term "expression vector" refers to a vector that is suitable for transformation of a host cell and contains nucleic acid sequences that direct and/or control expression of inserted heterologous nucleic acid sequences. Expression includes, but is not limited to, processes such as transcription, translation, and RNA splicing, if introns are present.

As will be understood by those skilled in the art, polynucleotides may include genomic sequences, extra-genomic and plasmid-encoded sequences and smaller engineered gene segments that express, or may be adapted to express, proteins, polypeptides, peptides and the like. Such segments may be naturally isolated, or modified synthetically by the skilled person.

As will be also recognized by the skilled artisan, polynucleotides may be single-stranded (coding or antisense) or double-stranded, and may be DNA (genomic, cDNA or synthetic) or RNA molecules. RNA molecules may include HnRNA molecules, which contain introns and correspond to a DNA molecule in a one-to-one manner, and mRNA molecules, which do not contain introns. Additional coding or non-coding sequences may, but need not, be present within a polynucleotide according to the present disclosure, and a polynucleotide may, but need not, be linked to other molecules and/or support materials. Polynucleotides may comprise a native sequence or may comprise a sequence that encodes a variant or derivative of such a sequence.

It will be appreciated by those of ordinary skill in the art that, as a result of the degeneracy of the genetic code, there are many nucleotide sequences that encodes an antibody as described herein. Some of these polynucleotides bear minimal sequence identity to the nucleotide sequence of the native or original polynucleotide sequence encoding a polypeptide within a Wnt surrogate molecule. Nonetheless, polynucleotides that vary due to differences in codon usage are expressly contemplated by the present disclosure. In certain embodiments, sequences that have been codon-optimized for mammalian expression are specifically contemplated.

Therefore, in another embodiment of the invention, a mutagenesis approach, such as site-specific mutagenesis, may be employed for the preparation of variants and/or derivatives of the polypeptides described herein. By this approach, specific modifications in a polypeptide sequence can be made through mutagenesis of the underlying polynucleotides that encode them. These techniques provide a straightforward approach to prepare and test sequence variants, for example, incorporating one or more of the foregoing considerations, by introducing one or more nucleotide sequence changes into the polynucleotide.

Site-specific mutagenesis allows the production of mutants through the use of specific oligonucleotide sequences which encode the DNA sequence of the desired mutation, as well as a sufficient number of adjacent nucleotides, to provide a primer sequence of sufficient size and sequence complexity to form a stable duplex on both sides of the deletion junction being traversed. Mutations may be employed in a selected polynucleotide sequence to improve, alter, decrease, modify, or otherwise change the properties of the polynucleotide itself, and/or alter the properties, activity, composition, stability, or primary sequence of the encoded polypeptide.

In certain embodiments, the inventors contemplate the mutagenesis of the polynucleotide sequences that encode a polypeptide present in a Wnt surrogate molecule, to alter one or more properties of the encoded polypeptide, such as the binding affinity, or the function of a particular Fc region, or the affinity of the Fc region for a particular FcγR. The techniques of site-specific mutagenesis are well-known in the art, and are widely used to create variants of both polypeptides and polynucleotides. For example, site-specific mutagenesis is often used to alter a specific portion of a DNA molecule. In such embodiments, a primer comprising typically about 14 to about 25 nucleotides or so in length is employed, with about 5 to about 10 residues on both sides of the junction of the sequence being altered.

As will be appreciated by those of skill in the art, site-specific mutagenesis techniques have often employed a phage vector that exists in both a single stranded and double stranded form. Typical vectors useful in site-directed mutagenesis include vectors such as the M13 phage. These phages are readily commercially available and their use is generally well-known to those skilled in the art. Double-stranded plasmids are also routinely employed in site directed mutagenesis that eliminates the step of transferring the gene of interest from a plasmid to a phage.

The preparation of sequence variants of the selected peptide-encoding DNA segments using site-directed mutagenesis provides a means of producing potentially useful species and is not meant to be limiting as there are other ways in which sequence variants of peptides and the DNA sequences encoding them may be obtained. For example, recombinant vectors encoding the desired peptide sequence may be treated with mutagenic agents, such as hydroxylamine, to obtain sequence variants. Specific details regarding these methods and protocols are found in the teachings of Maloy et al., 1994; Segal, 1976; Prokop and Bajpai, 1991; Kuby, 1994; and Maniatis et al., 1982, each incorporated herein by reference, for that purpose.

In many embodiments, one or more nucleic acids encoding a polypeptide of a Wnt surrogate molecule are introduced directly into a host cell, and the cell incubated under conditions sufficient to induce expression of the encoded polypeptides. The Wnt surrogate polypeptides of this disclosure may be prepared using standard techniques well known to those of skill in the art in combination with the polypeptide and nucleic acid sequences provided herein. The polypeptide sequences may be used to determine appropriate nucleic acid sequences encoding the particular polypeptide disclosed thereby. The nucleic acid sequence may be optimized to reflect particular codon "preferences" for various expression systems according to standard methods well known to those of skill in the art.

According to certain related embodiments there is provided a recombinant host cell which comprises one or more constructs as described herein, e.g., a vector comprising a nucleic acid encoding a Wnt surrogate molecule or polypeptide thereof; and a method of production of the encoded product, which method comprises expression from encoding nucleic acid therefor. Expression may conveniently be achieved by culturing under appropriate conditions recombinant host cells containing the nucleic acid. Following production by expression, an antibody or antigen-binding fragment thereof, may be isolated and/or purified using any suitable technique, and then used as desired.

Polypeptides, and encoding nucleic acid molecules and vectors, may be isolated and/or purified, e.g. from their natural environment, in substantially pure or homogeneous form, or, in the case of nucleic acid, free or substantially free of nucleic acid or genes of origin other than the sequence encoding a polypeptide with the desired function. Nucleic acid may comprise DNA or RNA and may be wholly or partially synthetic. Reference to a nucleotide sequence as set out herein encompasses a DNA molecule with the specified sequence, and encompasses a RNA molecule with the specified sequence in which U is substituted for T, unless context requires otherwise.

Systems for cloning and expression of a polypeptide in a variety of different host cells are well known. Suitable host cells include bacteria, mammalian cells, yeast and baculovirus systems. Mammalian cell lines available in the art for expression of a heterologous polypeptide include Chinese hamster ovary cells, HeLa cells, baby hamster kidney cells, NSO mouse melanoma cells and many others. A common, preferred bacterial host is *E. coli*.

The expression of polypeptides, e.g., antibodies and antigen-binding fragments thereof, in prokaryotic cells such as *E. coli* is well established in the art. For a review, see for example Pluckthun, A. Bio/Technology 9: 545-551 (1991). Expression in eukaryotic cells in culture is also available to those skilled in the art as an option for production of antibodies or antigen-binding fragments thereof, see recent reviews, for example Ref, M. E. (1993) Curr. Opinion Biotech. 4: 573-576; Trill J. J. et al. (1995) Curr. Opinion Biotech 6: 553-560.

Suitable vectors can be chosen or constructed, containing appropriate regulatory sequences, including promoter sequences, terminator sequences, polyadenylation sequences, enhancer sequences, marker genes and other sequences as appropriate. Vectors may be plasmids, viral e.g. phage, or phagemid, as appropriate. For further details see, for example, Molecular Cloning: a Laboratory Manual: 2nd edition, Sambrook et al., 1989, Cold Spring Harbor Laboratory Press. Many known techniques and protocols for manipulation of nucleic acid, for example in preparation of nucleic acid constructs, mutagenesis, sequencing, introduction of DNA into cells and gene expression, and analysis of proteins, are described in detail in Current Protocols in Molecular Biology, Second Edition, Ausubel et al. eds., John Wiley & Sons, 1992, or subsequent updates thereto.

The term "host cell" is used to refer to a cell into which has been introduced, or which is capable of having introduced into it, a nucleic acid sequence encoding one or more of the herein described polypeptides, and which further expresses or is capable of expressing a selected gene of interest, such as a gene encoding any herein described polypeptide. The term includes the progeny of the parent cell, whether or not the progeny are identical in morphology or in genetic make-up to the original parent, so long as the selected gene is present. Accordingly there is also contemplated a method comprising introducing such nucleic acid into a host cell. The introduction may employ any available technique. For eukaryotic cells, suitable techniques may include calcium phosphate transfection, DEAE-Dextran, electroporation, liposome-mediated transfection and transduction using retrovirus or other virus, e.g. vaccinia or, for insect cells, baculovirus. For bacterial cells, suitable techniques may include calcium chloride transformation, electroporation and transfection using bacteriophage. The introduction may be followed by causing or allowing expression from the nucleic acid, e.g. by culturing host cells under conditions for expression of the gene. In one embodiment, the nucleic acid is integrated into the genome (e.g. chromosome) of the host cell. Integration may be promoted by inclusion of sequences which promote recombination with the genome, in accordance-with standard techniques.

The present invention also provides, in certain embodiments, a method which comprises using a construct as stated above in an expression system in order to express a particular polypeptide such as a Wnyt mimetic molecule as described herein. The term "transduction" is used to refer to the transfer of genes from one bacterium to another, usually by a phage. "Transduction" also refers to the acquisition and transfer of eukaryotic cellular sequences by retroviruses. The term "transfection" is used to refer to the uptake of foreign or exogenous DNA by a cell, and a cell has been "transfected" when the exogenous DNA has been introduced inside the cell membrane. A number of transfection techniques are well known in the art and are disclosed herein. See, e.g., Graham et al., 1973, Virology 52:456; Sambrook et al., 2001, MOLECULAR CLONING, A LABORATORY MANUAL, Cold Spring Harbor Laboratories; Davis et al., 1986, BASIC METHODS IN MOLECULAR BIOLOGY, Elsevier; and Chu et al., 1981, Gene 13:197. Such techniques can be used to introduce one or more exogenous DNA moieties into suitable host cells.

The term "transformation" as used herein refers to a change in a cell's genetic characteristics, and a cell has been transformed when it has been modified to contain a new DNA. For example, a cell is transformed where it is genetically modified from its native state. Following transfection or transduction, the transforming DNA may recombine with that of the cell by physically integrating into a chromosome of the cell, or may be maintained transiently as an episomal element without being replicated, or may replicate independently as a plasmid. A cell is considered to have been stably transformed when the DNA is replicated with the division of the cell. The term "naturally occurring" or "native" when used in connection with biological materials such as nucleic acid molecules, polypeptides, host cells, and the like, refers to materials which are found in nature and are not manipulated by a human. Similarly, "non-naturally occurring" or "non-native" as used herein refers to a material that is not found in nature or that has been structurally modified or synthesized by a human.

The terms "polypeptide" "protein" and "peptide" and "glycoprotein" are used interchangeably and mean a polymer of amino acids not limited to any particular length. The term does not exclude modifications such as myristylation, sulfation, glycosylation, phosphorylation and addition or deletion of signal sequences. The terms "polypeptide" or "protein" means one or more chains of amino acids, wherein each chain comprises amino acids covalently linked by peptide bonds, and wherein said polypeptide or protein can comprise a plurality of chains non-covalently and/or covalently linked together by peptide bonds, having the sequence of native proteins, that is, proteins produced by naturally-occurring and specifically non-recombinant cells, or genetically-engineered or recombinant cells, and comprise molecules having the amino acid sequence of the native protein, or molecules having deletions from, additions to, and/or substitutions of one or more amino acids of the native sequence. The terms "polypeptide" and "protein" specifically encompass Wnt surrogate molecules, Fzd binding regions thereof, LRP5/6 binding regions thereof, antibodies and antigen-binding fragments thereof that bind to a Fzd receptor or a LRP5 or LRP6 receptor disclosed herein, or sequences that have deletions from, additions to, and/or substitutions of one or more amino acid of any of these polypeptides. Thus, a "polypeptide" or a "protein" can comprise one (termed "a monomer") or a plurality (termed "a multimer") of amino acid chains.

The term "isolated protein," "isolated Wnt surrogate molecule or "isolated antibody" referred to herein means that a subject protein, Wnt surrogate molecule, or antibody: (1) is free of at least some other proteins with which it would typically be found in nature; (2) is essentially free of other proteins from the same source, e.g., from the same species, (3) is expressed by a cell from a different species; (4) has been separated from at least about 50 percent of polynucleotides, lipids, carbohydrates, or other materials with which it is associated in nature; (5) is not associated (by covalent or noncovalent interaction) with portions of a protein with which the "isolated protein" is associated in nature; (6) is operably associated (by covalent or noncovalent interaction) with a polypeptide with which it is not associated in nature; or (7) does not occur in nature. Such an isolated protein can be encoded by genomic DNA, cDNA, mRNA or other RNA, or may be of synthetic origin, or any combination thereof. In certain embodiments, an isolated protein may comprise naturally-occurring and/or artificial polypeptide sequences. In certain embodiments, the isolated protein is substantially free from proteins or polypeptides or other contaminants that are found in its natural environment that would interfere with its use (therapeutic, diagnostic, prophylactic, research or otherwise).

Amino acid sequence modification(s) of any of the polypeptides (e.g., Wnt surrogate molecules or Fzd binding regions or LRP5/6 binding regions thereof) described herein are contemplated. For example, it may be desirable to improve the binding affinity and/or other biological properties of the Wnt surrogate molecule. For example, amino acid sequence variants of a Wnt surrogate molecule may be prepared by introducing appropriate nucleotide changes into a polynucleotide that encodes the antibody, or a chain thereof, or by peptide synthesis. Such modifications include, for example, deletions from, and/or insertions into and/or substitutions of, residues within the amino acid sequences of the antibody. Any combination of deletion, insertion, and substitution may be made to arrive at the final Wnt surrogate molecule, provided that the final construct possesses the desired characteristics (e.g., high affinity binding to one or more Fzd and/or LRP5/6 receptor). The amino acid changes also may alter post-translational processes of the antibody, such as changing the number or position of glycosylation sites. Any of the variations and modifications described above for polypeptides of the present invention may be included in antibodies of the present invention.

The present disclosure provides variants of any of the polypeptides (e.g., Wnt surrogate molecules or Fzd binding regions or LRP5/6 binding regions thereof, or antibodies or antigen-binding fragments thereof) disclosed herein. In certain embodiments, a variant has at least 90%, at least 95%, at least 98%, or at least 99% identity to a polypeptide disclosed herein. In certain embodiments, such variant polypeptides bind to one or more Fzd receptor, and/or to one or more LRP5/6 receptor, at least about 50%, at least about 70%, and in certain embodiments, at least about 90% as well as a Wnt surrogate molecule specifically set forth herein. In further embodiments, such variant Wnt surrogate molecules bind to one or more Fzd receptor, and/or to one or more LRP5/6 receptor, with greater affinity than the Wnt surrogate molecules set forth herein, for example, that bind quantitatively at least about 105%, 106%, 107%, 108%, 109%, or 110% as well as an antibody sequence specifically set forth herein.

In particular embodiments, the Wnt surrogate molecule or a binding region thereof, e.g., a Fab, scFv, or VHH or sdAb may comprise: a) a heavy chain variable region comprising: i. a CDR1 region that is identical in amino acid sequence to the heavy chain CDR1 region of a selected antibody described herein; ii. a CDR2 region that is identical in amino acid sequence to the heavy chain CDR2 region of the selected antibody; and iii. a CDR3 region that is identical in amino acid sequence to the heavy chain CDR3 region of the selected antibody; and/or b) a light chain variable domain comprising: i. a CDR1 region that is identical in amino acid sequence to the light chain CDR1 region of the selected antibody; ii. a CDR2 region that is identical in amino acid sequence to the light chain CDR2 region of the selected antibody; and iii. a CDR3 region that is identical in amino acid sequence to the light chain CDR3 region of the selected antibody; wherein the antibody specifically binds a selected target (e.g., one or more Fzd receptors or LRP5 or LRP6 receptors). In a further embodiment, the antibody, or antigen-binding fragment thereof, is a variant antibody or antigen-binding fragment thereof wherein the variant comprises a heavy and light chain identical to the selected antibody except for up to 8, 9, 10, 11, 12, 13, 14, 15, or more amino acid substitutions in the CDR regions of the VH and VL regions. In this regard, there may be 1, 2, 3, 4, 5, 6, 7, 8, or in certain embodiments, 9, 10, 11, 12, 13, 14, 15 more amino acid substitutions in the CDR regions of the selected antibody. Substitutions may be in CDRs either in the VH and/or the VL regions. (See e.g., Muller, 1998, Structure 6:1153-1167).

In particular embodiments, the Wnt surrogate molecule or a binding region thereof, e.g., a Fab, scFv, or VHH or sdAb may have: a) a heavy chain variable region having an amino acid sequence that is at least 80% identical, at least 95% identical, at least 90%, at least 95% or at least 98% or 99% identical, to the heavy chain variable region of an antibody or antigen-binding fragments thereof described herein; and/or b) a light chain variable region having an amino acid sequence that is at least 80% identical, at least 85%, at least 90%, at least 95% or at least 98% or 99% identical, to the light chain variable region of an antibody or antigen-binding fragments thereof described herein. The amino acid sequence of illustrative antigen-binding fragments thereof are set forth in SEQ ID NOs:1-128.

A polypeptide has a certain percent "sequence identity" to another polypeptide, meaning that, when aligned, that percentage of amino acids are the same when comparing the two sequences. Sequence similarity can be determined in a number of different manners. To determine sequence identity, sequences can be aligned using the methods and computer programs, including BLAST, available over the world wide web at ncbi.nlm.nih.gov/BLAST/. Another alignment algorithm is FASTA, available in the Genetics Computing Group (GCG) package, from Madison, Wis., USA, a wholly owned subsidiary of Oxford Molecular Group, Inc. Other techniques for alignment are described in Methods in Enzymology, vol. 266: Computer Methods for Macromolecular Sequence Analysis (1996), ed. Doolittle, Academic Press, Inc., a division of Harcourt Brace & Co., San Diego, Calif., USA. Of particular interest are alignment programs that permit gaps in the sequence. The Smith-Waterman is one type of algorithm that permits gaps in sequence alignments. See Meth. Mol. Biol. 70: 173-187 (1997). Also, the GAP program using the Needleman and Wunsch alignment method can be utilized to align sequences. See J. Mol. Biol. 48: 443-453 (1970)

Of interest is the BestFit program using the local homology algorithm of Smith and Waterman (Advances in Applied Mathematics 2: 482-489 (1981) to determine sequence identity. The gap generation penalty will generally range from 1 to 5, usually 2 to 4 and in many embodiments will be 3. The gap extension penalty will generally range from about 0.01 to 0.20 and in many instances will be 0.10. The program has default parameters determined by the sequences inputted to be compared. Preferably, the sequence identity is determined using the default parameters determined by the program. This program is available also from Genetics Computing Group (GCG) package, from Madison, Wis., USA.

Another program of interest is the FastDB algorithm. FastDB is described in Current Methods in Sequence Comparison and Analysis, Macromolecule Sequencing and Synthesis, Selected Methods and Applications, pp. 127-149, 1988, Alan R. Liss, Inc. Percent sequence identity is calculated by FastDB based upon the following parameters: Mismatch Penalty: 1.00; Gap Penalty: 1.00; Gap Size Penalty: 0.33; and Joining Penalty: 30.0.

In particular embodiments, the Wnt surrogate molecule or a binding region thereof, e.g., a Fab, scFv, or VHH or sdAb may comprise: a) a heavy chain variable region comprising: i. a CDR1 region that is identical in amino acid sequence to the heavy chain CDR1 region of a selected antibody described herein; ii. a CDR2 region that is identical in amino acid sequence to the heavy chain CDR2 region of the selected antibody; and iii. a CDR3 region that is identical in amino acid sequence to the heavy chain CDR3 region of the selected antibody; and b) a light chain variable domain comprising: i. a CDR1 region that is identical in amino acid sequence to the light chain CDR1 region of the selected antibody; ii. a CDR2 region that is identical in amino acid sequence to the light chain CDR2 region of the selected antibody; and iii. a CDR3 region that is identical in amino acid sequence to the light chain CDR3 region of the selected antibody; wherein the antibody specifically binds a selected target (e.g., a Fzd receptor, such as Fzd1). In a further embodiment, the antibody, or antigen-binding fragment thereof, is a variant antibody wherein the variant comprises a heavy and light chain identical to the selected antibody except for up to 8, 9, 10, 11, 12, 13, 14, 15, or more amino acid substitutions in the CDR regions of the VH and VL regions. In this regard, there may be 1, 2, 3, 4, 5, 6, 7, 8, or in certain embodiments, 9, 10, 11, 12, 13, 14, 15 more amino acid substitutions in the CDR regions of the selected antibody. Substitutions may be in CDRs either in the VH and/or the VL regions. (See e.g., Muller, 1998, Structure 6:1153-1167).

Determination of the three-dimensional structures of representative polypeptides (e.g., variant Fzd binding regions or LRP5/6 binding regions of Wnt surrogate molecules as provided herein) may be made through routine methodologies such that substitution, addition, deletion or insertion of one or more amino acids with selected natural or non-natural amino acids can be virtually modeled for purposes of determining whether a so derived structural variant retains the space-filling properties of presently disclosed species. See, for instance, Donate et al., 1994 *Prot. Sci.* 3:2378; Bradley et al., *Science* 309: 1868-1871 (2005); Schueler-Furman et al., *Science* 310:638 (2005); Dietz et al., *Proc. Nat. Acad. Sci. USA* 103:1244 (2006); Dodson et al., *Nature* 450:176 (2007); Qian et al., *Nature* 450:259 (2007); Raman et al. *Science* 327:1014-1018 (2010). Some additional non-limiting examples of computer algorithms that may be used for these and related embodiments, such as for rational design of binding regions include VMD which is a molecular visualization program for displaying, animating, and analyzing large biomolecular systems using 3-D graphics and built-in scripting (see the website for the Theoretical and Computational Biophysics Group, University of Illinois at Urbana-Champagne, at ks.uiuc.edu/Research/vmd/. Many other computer programs are known in the art and available to the skilled person and which allow for determining atomic dimensions from space-filling models (van der Waals radii) of energy-minimized conformations; GRID, which seeks to determine regions of high affinity for different chemical groups, thereby enhancing binding, Monte Carlo searches, which calculate mathematical alignment, and CHARMM (Brooks et al. (1983) *J. Comput. Chem.* 4:187-217) and AMBER (Weiner et al (1981) *J. Comput. Chem.* 106: 765), which assess force field calculations, and analysis (see also, Eisenfield et al. (1991) *Am. J. Physiol.* 261:C376-386; Lybrand (1991) *J. Pharm. Belg.* 46:49-54; Froimowitz (1990) *Biotechniques* 8:640-644; Burbam et al. (1990) *Proteins* 7:99-111; Pedersen (1985) *Environ. Health Perspect.* 61:185-190; and Kini et al. (1991) *J. Biomol. Struct. Dyn.* 9:475-488). A variety of appropriate computational computer programs are also commercially available, such as from Schrödinger (Munich, Germany).

Compositions

Pharmaceutical compositions comprising a Wnt surrogate molecule described herein and one or more pharmaceutically acceptable diluent, carrier, or excipient are also disclosed. In particular embodiments, the pharmaceutical composition further comprises one or more Wnt polypeptides or Norrin polypeptides.

In further embodiments, pharmaceutical compositions comprising a polynucleotide comprising a nucleic acid sequence encoding a Wnt surrogate molecule described herein and one or more pharmaceutically acceptable diluent, carrier, or excipient are also disclosed. In particular embodiments, the pharmaceutical composition further comprises one or more polynucleotides comprising a nucleic acid sequence encoding a Wnt polypeptide or Norrin polypeptide. In certain embodiments, the polynucleotides are DNA or mRNA, e.g., a modified mRNA. In particular embodiments, the polynucleotides are modified mRNAs further comprising a 5' cap sequence and/or a 3' tailing sequence, e.g., a polyA tail. In other embodiments, the polynucleotides are expression cassettes comprising a promoter operatively linked to the coding sequences. In certain embodiments, the nucleic acid sequence encoding the Wnt surrogate molecule and the nucleic acid sequence encoding the Wnt polypeptide or Norrin polypeptide are present in the same polynucleotide.

In further embodiments, pharmaceutical compositions comprising an expression vector, e.g., a viral vector, comprising a polynucleotide comprising a nucleic acid sequence encoding a Wnt surrogate molecule described herein and one or more pharmaceutically acceptable diluent, carrier, or excipient are also disclosed. In particular embodiments, the pharmaceutical composition further comprises an expression vector, e.g., a viral vector, comprising a polynucleotide comprising a nucleic acid sequence encoding a Wnt polypeptide or Norrin polypeptide. In certain embodiments, the nucleic acid sequence encoding the Wnt surrogate molecule and the nucleic acid sequence encoding the Wnt polypeptide or Norrin polypeptide are present in the same polynucleotide, e.g., expression cassette.

The present invention further contemplates a pharmaceutical composition comprising a cell comprising an expression vector comprising a polynucleotide comprising a promoter operatively linked to a nucleic acid encoding a Wnt surrogate molecule and one or more pharmaceutically acceptable diluent, carrier, or excipient. In particular embodiments, the pharmaceutical composition further comprises a cell comprising an expression vector comprising a polynucleotide comprising a promoter operatively linked to a nucleic acid sequence encoding a Wnt polypeptide or a Norrin polypeptide. In certain embodiments, the nucleic acid sequence encoding the Wnt surrogate molecule and the nucleic acid sequence encoding the Wnt polypeptide or Norrin polypeptide are present in the same polynucleotide, e.g., expression cassette and/or in the same cell. In particular embodiments, the cell is a heterologous cell or an autologous cell obtained from the subject to be treated. In particular embodiments, the cell is a stem cell, e.g., an adipose-derived stem cell or a hematopoietic stem cell.

The present disclosure contemplates pharmaceutical compositions comprising a first molecule for delivery of a Wnt surrogate molecule as a first active agent and a second molecule for delivery of a Wnt polypeptide or Norrin polypeptide. The first and second molecule may be the same type of molecule or different types of molecules. For example, in certain embodiments, the first and second molecule may each be independently selected from the following types of molecules: polypeptides, small organic molecules, nucleic acids encoding the first or second active agent (optionally DNA or mRNA, optionally modified RNA), vectors comprising a nucleic acid sequence encoding the first or second active agent (optionally expression vectors or viral vectors), and cells comprising a nucleic acid sequence encoding the first or second active agent (optionally an expression cassette).

The subject molecules, alone or in combination, can be combined with pharmaceutically-acceptable carriers, diluents, excipients and reagents useful in preparing a formulation that is generally safe, non-toxic, and desirable, and includes excipients that are acceptable for mammalian, e.g., human or primate, use. Such excipients can be solid, liquid, semisolid, or, in the case of an aerosol composition, gaseous. Examples of such carriers, diluents and excipients include, but are not limited to, water, saline, Ringer's solutions, dextrose solution, and 5% human serum albumin. Supplementary active compounds can also be incorporated into the formulations. Solutions or suspensions used for the formulations can include a sterile diluent such as water for injection, saline solution, fixed oils, polyethylene glycols, glycerine, propylene glycol or other synthetic solvents; antibacterial compounds such as benzyl alcohol or methyl parabens; antioxidants such as ascorbic acid or sodium bisulfite; chelating compounds such as ethylenediaminetetraacetic acid (EDTA); buffers such as acetates, citrates or phosphates; detergents such as Tween 20 to prevent aggregation; and compounds for the adjustment of tonicity such as sodium chloride or dextrose. The pH can be adjusted with acids or bases, such as hydrochloric acid or sodium hydroxide. In particular embodiments, the pharmaceutical compositions are sterile.

Pharmaceutical compositions may further include sterile aqueous solutions or dispersions and sterile powders for the extemporaneous preparation of sterile injectable solutions or dispersion. For intravenous administration, suitable carriers include physiological saline, bacteriostatic water, or phosphate buffered saline (PBS). In some cases, the composition is sterile and should be fluid such that it can be drawn into a syringe or delivered to a subject from a syringe. In certain embodiments, it is stable under the conditions of manufacture and storage and is preserved against the contaminating action of microorganisms such as bacteria and fungi. The carrier can be, e.g., a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as mannitol, sorbitol, sodium chloride in the composition. Prolonged absorption of the internal compositions can be brought about by including in the composition an agent which delays absorption, for example, aluminum monostearate and gelatin.

Sterile solutions can be prepared by incorporating the anti-Fzd antibody or antigen-binding fragment thereof (or encoding polynucleotide or cell comprising the same) in the required amount in an appropriate solvent with one or a combination of ingredients enumerated above, as required, followed by filtered sterilization. Generally, dispersions are prepared by incorporating the active compound into a sterile vehicle that contains a basic dispersion medium and the required other ingredients from those enumerated above. In the case of sterile powders for the preparation of sterile injectable solutions, methods of preparation are vacuum drying and freeze-drying that yields a powder of the active ingredient plus any additional desired ingredient from a previously sterile-filtered solution thereof.

In one embodiment, the pharmaceutical compositions are prepared with carriers that will protect the antibody or antigen-binding fragment thereof against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. The materials can also be obtained commercially. Liposomal suspensions can also be used as pharmaceutically acceptable carriers. These can be prepared according to methods known to those skilled in the art.

It may be advantageous to formulate the pharmaceutical compositions in dosage unit form for ease of administration and uniformity of dosage. Dosage unit form as used herein refers to physically discrete units suited as unitary dosages for the subject to be treated; each unit containing a predetermined quantity of active antibody or antigen-binding fragment thereof calculated to produce the desired therapeutic effect in association with the required pharmaceutical carrier. The specification for the dosage unit forms are dictated by and directly dependent on the unique characteristics of the antibody or antigen-binding fragment thereof and the particular therapeutic effect to be achieved, and the limitations inherent in the art of compounding such an active antibody or antigen-binding fragment thereof for the treatment of individuals.

The pharmaceutical compositions can be included in a container, pack, or dispenser, e.g. syringe, e.g. a prefilled syringe, together with instructions for administration.

The pharmaceutical compositions of the invention encompass any pharmaceutically acceptable salts, esters, or salts of such esters, or any other compound which, upon administration to an animal comprising a human, is capable of providing (directly or indirectly) the biologically active antibody or antigen-binding fragment thereof.

The present invention includes pharmaceutically acceptable salts of a Wnt surrogate molecule described herein. The term "pharmaceutically acceptable salt" refers to physiologically and pharmaceutically acceptable salts of the compounds of the invention: i.e., salts that retain the desired biological activity of the parent compound and do not impart undesired toxicological effects thereto. A variety of pharmaceutically acceptable salts are known in the art and described, e.g., in "Remington's Pharmaceutical Sciences", 17th edition, Alfonso R. Gennaro (Ed.), Mark Publishing Company, Easton, Pa., USA, 1985 (and more recent editions thereof), in the "Encyclopaedia of Pharmaceutical Technology", 3rd edition, James Swarbrick (Ed.), Informa Healthcare USA (Inc.), NY, USA, 2007, and in J. Pharm. Sci. 66: 2 (1977). Also, for a review on suitable salts, see "Handbook of Pharmaceutical Salts: Properties, Selection, and Use" by Stahl and Wermuth (Wiley-VCH, 2002).

Pharmaceutically acceptable base addition salts are formed with metals or amines, such as alkali and alkaline earth metals or organic amines. Metals used as cations comprise sodium, potassium, magnesium, calcium, and the like. Amines comprise N—N'-dibenzylethylenediamine, chloroprocaine, choline, diethanolamine, dicyclohexylamine, ethylenediamine, N-methylglucamine, and procaine (see, for example, Berge et al., "Pharmaceutical Salts," J. Pharma Sci., 1977, 66, 119). The base addition salts of said acidic compounds are prepared by contacting the free acid form with a sufficient amount of the desired base to produce the salt in the conventional manner. The free acid form may be regenerated by contacting the salt form with an acid and isolating the free acid in the conventional manner. The free acid forms differ from their respective salt forms somewhat in certain physical properties such as solubility in polar solvents, but otherwise the salts are equivalent to their respective free acid for purposes of the present invention.

In some embodiments, the pharmaceutical composition provided herein comprise a therapeutically effective amount of a Wnt surrogate molecule or pharmaceutically acceptable salt thereof in admixture with a pharmaceutically acceptable carrier, diluent and/or excipient, for example saline, phosphate buffered saline, phosphate and amino acids, polymers, polyols, sugar, buffers, preservatives and other proteins. Exemplary amino acids, polymers and sugars and the like are octylphenoxy polyethoxy ethanol compounds, polyethylene glycol monostearate compounds, polyoxyethylene sorbitan fatty acid esters, sucrose, fructose, dextrose, maltose, glucose, mannitol, dextran, sorbitol, inositol, galactitol, xylitol, lactose, trehalose, bovine or human serum albumin, citrate, acetate, Ringer's and Hank's solutions, cysteine, arginine, carnitine, alanine, glycine, lysine, valine, leucine, polyvinylpyrrolidone, polyethylene and glycol. Preferably, this formulation is stable for at least six months at 4° C.

In some embodiments, the pharmaceutical composition provided herein comprises a buffer, such as phosphate buffered saline (PBS) or sodium phosphate/sodium sulfate, tris buffer, glycine buffer, sterile water and other buffers known to the ordinarily skilled artisan such as those described by Good et al. (1966) Biochemistry 5:467. The pH of the buffer may be in the range of 6.5 to 7.75, preferably 7 to 7.5, and most preferably 7.2 to 7.4.

Methods of Use

The present disclosure also provides methods for using the Wnt surrogate molecules disclosed herein, e.g., to modulate a Wnt signaling pathway, e.g., to increase Wnt signaling, and the administration of a Wnt surrogate molecule disclosed herein in a variety of therapeutic settings. Provided herein are methods of treatment using a Wnt surrogate molecule. In one embodiment, a Wnt surrogate molecule is provided to a subject having a disease involving inappropriate or deregulated Wnt signaling, e.g., reduced Wnt signaling.

Increasing Wnt Pathway Signaling and Related Therapeutic Methods

In certain embodiments, a Wnt surrogate molecule may be used to increase Wnt signaling in a tissue or cell. Thus, in some aspects, the present invention provides a method for increasing Wnt signaling or enhancing Wnt signaling in a tissue or cell, comprising contacting the tissue or cell with an effective amount of a Wnt surrogate molecule or pharmaceutically acceptable salt thereof disclosed herein, wherein the a Wnt surrogate molecule is a Wnt signaling pathway agonist. In some embodiments, contacting occurs in vitro, ex vivo, or in vivo. In particular embodiments, the cell is a cultured cell, and the contacting occurs in vitro. In certain embodiments, the method comprises further contacting the tissue or cell with one or more Wnt polypeptides or Norrin polypeptides.

In related aspects, the present invention provides a method for increasing Wnt signaling in a tissue or cell, comprising contacting the tissue or cell with an effective amount of a polynucleotide comprising a Wnt surrogate molecule disclosed herein. In certain embodiments, the target tissue or cell is also contacted with a polynucleotide comprising a nucleic acid sequence that encodes a Wnt polypeptide or a Norrin polypeptide. In certain embodiments, the polynucleotides are DNA or mRNA, e.g., a modified mRNA. In particular embodiments, the polynucleotides are modified mRNAs further comprising a 5' cap sequence and/or a 3' tailing sequence, e.g., a polyA tail. In other embodiments, the polynucleotides are expression cassettes comprising a promoter operatively linked to the coding sequences. In certain embodiments, the nucleic acid sequence encoding the Wnt surrogate molecule and the nucleic acid sequence encoding the Wnt polypeptide or Norrin polypeptide are present in the same polynucleotide.

In related aspects, the present invention provides a method for increasing Wnt signaling in a tissue or cell, comprising contacting the tissue or cell with an effective amount of a vector comprising a nucleic acid sequence encoding a Wnt surrogate molecule. In certain embodiments, the tissue or cell is also contacted with a vector comprising a nucleic acid sequence that encodes a Wnt polypeptide or a Norrin polypeptide. In certain embodiments, the vector is an expression vector, and may comprise a promoter operatively linked to the nucleic acid sequence. In particular embodiments, the vector is a viral vector. In certain embodiments, the nucleic acid sequence encoding a Wnt surrogate molecule and the nucleic acid sequence encoding the Wnt polypeptide or Norrin polypeptide are present in the same vector, e.g., in the same expression cassette.

In related aspects, the present invention provides a method for increasing Wnt signaling in a tissue, comprising contacting the tissue with an effective amount of a cell comprising a nucleic acid sequence encoding a Wnt surrogate molecule of the present invention. In certain embodiments, the tissue is also contacted with a cell comprising a nucleic acid sequence that encodes a Wnt polypeptide or Norrin polypeptide. In certain embodiments, the nucleic acid sequence encoding the Wnt surrogate molecule and the nucleic acid sequence encoding the Wnt polypeptide or Norrin polypeptide are present in the same cell. In particular embodiments, the cell is a heterologous cell or an autologous cell obtained from the subject to be treated. In certain embodiments, the cell was transduced with a vector comprising an expression cassette encoding the Wnt surrogate molecule or the Wnt polypeptide or Norrin polypeptide. In particular embodiments, the cell is a stem cell, e.g., an adipose-derived stem cell or a hematopoietic stem cell.

Wnt surrogate molecules disclosed herein may be used in to treat a disease, disorder or condition, for example, by increasing Wnt signaling in a targeted cell, tissue or organ. Thus, in some aspects, the present invention provides a method for treating a disease or condition in a subject in need thereof, e.g., a disease or disorder associated with reduced Wnt signaling, or for which increased Wnt signaling would provide a therapeutic benefit, comprising contacting the subject with an effective amount of a composition of the present disclosure. In particular embodiments, the composition is a pharmaceutical composition comprising any of: a Wnt surrogate molecule; a polynucleotide comprising a nucleic acid sequence encoding a Wnt surrogate molecule, e.g., a DNA or mRNA, optionally a modified mRNA; a vector comprising a nucleic acid sequence encoding a Wnt surrogate molecule, e.g., an expression vector or viral vector; or a cell comprising a nucleic acid sequence encoding a Wnt surrogate molecule, e.g., a cell transduced with an expression vector or viral vector encoding a Wnt surrogate molecule. In particular embodiments, the disease or condition is a pathological disease or disorder, or an injury, e.g., an injury resulting from a wound. In certain embodiments, the wound may be the result of another therapeutic treatment. In certain embodiments, the disease or condition comprises impaired tissue repair, healing or regeneration, or would benefit from increased tissue repair, healing or regeneration. In some embodiments, contacting occurs in vivo, i.e., the subject composition is administered to a subject.

In certain embodiments, the method comprises further contacting the subject with a pharmaceutical composition comprising one or more Wnt polypeptides or Norrin polypeptides. The present disclosure contemplates contacting a subject with a first molecule for delivery of a Wnt surrogate molecule as a first active agent and a second molecule for delivery of a Wnt polypeptide or Norrin polypeptide. The first and second molecule may be the same type of molecule or different types of molecules. For example, in certain embodiments, the first and second molecule may each be independently selected from the following types of molecules: polypeptides, small organic molecules, nucleic acids encoding the first or second active agent (optionally DNA or mRNA, optionally modified RNA), vectors comprising a nucleic acid sequence encoding the first or second active agent (optionally expression vectors or viral vectors), and cells comprising a nucleic acid sequence encoding the first or second active agent (optionally an expression cassette).

In related aspects, the present invention provides a method for treating a disease or condition, e.g., a disease or disorder associated with reduced Wnt signaling, or for which increased Wnt signaling would provide a therapeutic benefit, comprising contacting a subject in need thereof with a pharmaceutical composition comprising an effective amount of a polynucleotide comprising a nucleic acid sequence encoding a Wnt surrogate molecule disclosed herein. In certain embodiments, the subject is also contacted with a pharmaceutical composition comprising an effective amount of a polynucleotide comprising a nucleic acid sequence that encodes a Wnt polypeptide or a Norrin polypeptide. In certain embodiments, the polynucleotides are DNA or mRNA, e.g., a modified mRNA. In particular embodiments, the polynucleotides are modified mRNAs further comprising a 5' cap sequence and/or a 3' tailing sequence, e.g., a polyA tail. In other embodiments, the polynucleotides are expression cassettes comprising a promoter operatively linked to the coding sequences. In certain embodiments, the nucleic acid sequence encoding the Wnt surrogate molecule and the nucleic acid sequence encoding the Wnt polypeptide or Norrin polypeptide are present in the same polynucleotide.

In related aspects, the present invention provides a method for treating a disease or condition, e.g., a disease or disorder associated with reduced Wnt signaling, or for which increased Wnt signaling would provide a therapeutic benefit, comprising contacting a subject in need thereof with a pharmaceutical composition comprising an effective amount of a vector comprising a nucleic acid sequence encoding a Wnt surrogate molecule. In certain embodiments, the subject is also contacted with a pharmaceutical composition comprising an effective amount of a vector comprising a nucleic acid sequence that encodes a Wnt polypeptide or a Norrin polypeptide. In certain embodiments, the vector is an expression vector, and may comprise a promoter operatively linked to the nucleic acid sequence. In particular embodiments, the vector is a viral vector. In certain embodiments, the nucleic acid sequence encoding the Wnt surrogate molecule and the nucleic acid sequence encoding the Wnt polypeptide or Norrin polypeptide are present in the same vector, e.g., in the same expression cassette.

In related aspects, the present invention provides a method for treating a disease or condition, e.g., a disease or disorder associated with reduced Wnt signaling, or for which increased Wnt signaling would provide a therapeutic benefit, comprising contacting a subject in need thereof with a pharmaceutical composition comprising an effective amount of a cell comprising a nucleic acid sequence encoding a Wnt surrogate molecule. In certain embodiments, the subject is also contacted with a cell comprising a nucleic acid sequence that encodes a Wnt polypeptide or a Norrin polypeptide. In certain embodiments, the nucleic acid sequence encoding the Wnt surrogate molecule and the nucleic acid sequence encoding the Wnt polypeptide or Norrin polypeptide are present in the same cell. In particular embodiments, the cell is a heterologous cell or an autologous cell obtained from the subject to be treated. In certain embodiments, the cell was transduced with a vector comprising an expression cassette encoding the Wnt surrogate molecule or the Wnt polypeptide or Norrin polypeptide. In particular embodiments, the cell is a stem cell, e.g., an adipose-derived stem cell or a hematopoietic stem cell.

Wnt signaling plays key roles in the developmental process and maintenance of stem cells. Reactivation of Wnt signals is associated with regeneration and repair of most tissues after injuries and diseases. Wnt surrogate molecule molecules are expected to provide benefit of healing and tissue repair in response to injuries and diseases. Causes of tissue damage and loss include but are not limited to aging, degeneration, hereditary conditions, infection and inflammation, traumatic injuries, toxins/metabolic-induced toxicities, or other pathological conditions. Wnt signals and enhancers of Wnt signals have been shown to activate adult, tissue-resident stem cells. In some embodiments, the compounds of the invention are administered for use in treating diseased or damaged tissue, for use in tissue regeneration and for use in cell growth and proliferation, and/or for use in tissue engineering.

Human diseases associated with mutations of the Wnt pathway provide strong evidence for enhancement of Wnt signals in the treatment and prevention of diseases. Preclinical in vivo and in vitro studies provide additional evidence of involvement of Wnt signals in many disease conditions and further support utilization of a Wnt surrogate molecule in various human diseases. For example, compositions of the present invention may be used to promote or increase bone growth or regeneration, bone grafting, healing of bone fractures, treatment of osteoporosis and osteoporotic fractures, spinal fusion, spinal cord injuries, including vertebral compression fractures, pre-operative spinal surgery optimization, osseointegration of orthopedic devices, tendon-bone integration, tooth growth and regeneration, dental implantation, periodontal diseases, maxillofacial reconstruction, and osteonecrosis of the jaw. They may also be used in the treatment of alopecia; enhancing regeneration of sensory organs, e.g. treatment of hearing loss, including regeneration of inner and outer auditory hair cells treatment of vestibular hypofunction, treatment of macular degeneration, treatment of retinopathies, including vitreoretinopathy, diabetic retinopathy, other diseases of retinal degeneration, Fuchs' dystrophy, other cornea disease, etc.; treatment of stroke, traumatic brain injury, Alzheimer's disease, multiple sclerosis, multiple dystrophy, muscle atrophy as a result of sarcopenia or cachexia, and other conditions affecting the degeneration or integrity of the blood brain barrier; The compositions of this invention may also be used in treatment of oral mucositis, treatment of short bowel syndrome, inflammatory bowel diseases (IBD), including Crohn's disease (CD) and ulcerative colitis (UC), in particular CD with fistula formation, other gastrointestinal disorders; treatment of metabolic syndrome, dyslipidemia, treatment of diabetes, treatment of pancreatitis, conditions where exocrine or endocrine pancreas tissues are damaged; conditions where enhanced epidermal regeneration is desired, e.g., epidermal wound healing, treatment of diabetic foot ulcers, syndromes involving tooth, nail, or dermal hypoplasia, etc., conditions where angiogenesis is beneficial; treatment of myocardial infarction, coronary artery disease, heart failure; enhanced growth of hematopoietic cells, e.g. enhancement of hematopoietic stem cell transplants from bone marrow, mobilized peripheral blood, treatment of immunodeficiencies, graft versus host diseases, etc.; treatment of acute kidney injuries, chronic kidney diseases; treatment of lung diseases, chronic obstructive pulmonary diseases (COPD), pulmonary fibrosis, including idiopathic pulmonary fibrosis, enhanced regeneration of lung tissues. The compositions of the present invention may also be used in enhanced regeneration of liver cells, e.g. liver regeneration, treatment of cirrhosis, enhancement of liver transplantations, treatment of acute liver failure, treatment of chronic liver diseases with hepatitis C or B virus infection or post-antiviral drug therapies, alcoholic liver diseases, including alcoholic hepatitis, non-alcoholic liver diseases with steatosis or steatohepatitis, and the like. The compositions of this invention may treat diseases and disorders including, without limitation, conditions in which regenerative cell growth is desired.

Human genetics involving loss-of-function or gain-of-function mutations in Wnt signaling components show strong evidence supporting enhancing Wnt signals for bone growth. Conditions in which enhanced bone growth is desired may include, without limitation, fractures, grafts, ingrowth around prosthetic devices, osteoporosis, osteoporotic fractures, spinal fusion, vertebral compression fractures, pre-operative optimization for spinal surgeries, osteonecrosis of the jaw, dental implantation, periodontal diseases, maxillofacial reconstruction, and the like. Wnt surrogate molecules enhance and promotes Wnt signals which are critical in promoting bone regeneration. Methods for regeneration of bone tissues benefit from administration of the compounds of the invention, which can be systemic or localized. In some embodiments, bone marrow cells are exposed to molecules of the invention, such that stem cells within that marrow become activated.

In some embodiments, bone regeneration is enhanced by contacting a responsive cell population, e.g. bone marrow, bone progenitor cells, bone stem cells, etc. with an effective dose of a Wnt surrogate molecule disclosed herein. Methods for regeneration of bone tissues benefit from administration of the Wnt surrogate molecule which can be systemic or localized. In some such embodiments, the contacting is performed in vivo. In other such embodiments, the contacting is performed ex vivo. The molecule may be localized to the site of action, e.g. by loading onto a matrix, which is optionally biodegradable, and optionally provides for a sustained release of the active agent. Matrix carriers include, without limitation, absorbable collagen sponges, ceramics, hydrogels, polymeric microspheres, nanoparticles, bone cements, and the like.

In particular embodiments, compositions comprising one or more Wnt surrogate molecule disclosed herein (or a polynucleotide encoding a Wnt surrogate molecule, or a vector or cell comprising a polynucleotide encoding a Wnt surrogate molecule) are used to treat or prevent a bone disease or disorder, including but not limited to any of the following, or to treat or prevent an injury associated with, but not limited to, any of the following: osteoporosis, osteoporotic fractures, bone fractures including vertebral compression fractures, non-union fractures, delayed union fractures, spinal fusion, osteonecrosis, osteonecrosis of the jaw, hip, femoral head, etc., osseointegration of implants (e.g., to accelerate recovery following partial or total knee or hip replacement), osteogenesis imperfecta, bone grafts, tendon repair, maxillofacial surgery, dental implant, all other bone disorders or defects resulting from genetic diseases, degeneration, aging, drugs, or injuries. In one embodiment, Wnt surrogate molecules that bind Fzd1, Fzd 2, and Fzd 7, and also LRP5 and/or LRP6, are used to treat or prevent any bone disease or disorder. In one embodiment, Wnt surrogate molecules that bind Fzd1, Fzd 2, Fzd 5, Fzd 7 and Fzd 8, and also LRP5 and/or LRP6, are used to treat or prevent any bone disease or disorder. Other Fzd molecules that bind to additional Fzd receptors can also be used with LRP5 and/or LRP6 binders.

In particular embodiments, compositions and methods disclosed herein may be used to: increase bone mineral density, increase bone volume (e.g., tibia and/or femur bone volume), increase cortical thickness (e.g., in trabecular region or in femur mid-diaphysis), increase mineral apposition rate, increase the number of osteblasts and/or decrease the number of osteoclasts (e.g., in bone), increase bone stiffness, increase the ultimate load to fracture point, improve bone resistance to fracture, decrease bone resorption, decrease bone loss associated with osteoporosis, or increase biochemical strength of bone, in a subject. In one embodiment, Wnt surrogate molecules that bind Fzd1, Fzd 2, and Fzd 7 are used for any of these indicated uses. In one embodiment, Wnt surrogate molecules that bind Fzd1, Fzd 2, Fzd 5, Fzd 7 and Fzd 8 are used for any of these indicated uses.

Methods disclosed herein, including methods for treating or preventing a bone disease or disorder include methods that comprise providing to a subject in need thereof both a Wnt surrogate molecule and an antiresorptive agent. In certain embodiments, the methods are used for the treatment of osteoporosis, optionally post-menopausal osteoporosis.

The disclosure also provides a method for inhibiting or reducing bone resorption in a subject in need thereof, comprising providing to the subject an effective amount of a Wnt surrogate molecule, wherein the Wnt surrogate molecule is an agonist of a Wnt signaling pathway. In certain embodiments, the method further comprises providing to the subject an antiresorptive agent. In certain embodiments, the subject has been diagnosed with or is at risk for osteoporosis, optionally postmenopausal osteoporosis. A variety of antiresorptive agents are known in the art and include, but are not limited to, those disclosed herein.

When a Wnt surrogate molecule is provide to the subject in combination with another therapeutic agent, such as an antiresorptive agent, the two agent may be provided in the same or different pharmaceutical compositions. They may be provided to the subject at the same time, at different times, e.g., simultaneously, consecutively, or during overlapping or non-overlapping time periods. In certain embodiments, the two agents are therapeutically active in the subject during an overlapping time period.

Compositions comprising one or more Wnt surrogate molecule disclosed herein (or a polynucleotide encoding a Wnt surrogate molecule, or a vector or cell comprising a polynucleotide encoding a Wnt surrogate molecule) can be used for the in vivo treatment of skeletal tissue deficiencies. By "skeletal tissue deficiency", it is meant a deficiency in bone or other skeletal connective tissue at any site where it is desired to restore the bone or connective tissue, no matter how the deficiency originated, e.g. whether as a result of surgical intervention, removal of tumor, ulceration, implant, fracture, or other traumatic or degenerative conditions. The compositions of the present invention can be used as part of a regimen for restoring cartilage function to a connective tissue, for the repair of defects or lesions in cartilage tissue such as degenerative wear and arthritis, trauma to the tissue, displacement of torn meniscus, meniscectomy, a luxation of a joint by a torn ligament, malalignment of joints, bone fracture, or by hereditary disease.

A Wnt surrogate molecule may also be used for treatment of periodontal diseases. Periodontal diseases are a leading cause of tooth loss and are linked to multiple systemic conditions. In some embodiments, tooth or underlying bone regeneration is enhanced by contacting a responsive cell population. In some such embodiments, the contacting is performed in vivo. In other such embodiments, the contacting is performed ex vivo, with subsequent implantation of the activated stem or progenitor cells. The molecule may be localized to the site of action, e.g. by loading onto a matrix, which is optionally biodegradable, and optionally provides for a sustained release of the active agent. Matrix carriers include, without limitation, absorbable collagen sponges, ceramics, hydrogels, bone cements, polymeric microspheres, nanoparticles, and the like.

Studies have shown that biology of Wnt signaling and R-spondins are capable of promoting sensory hair cell regeneration in the inner ear following injuries, aging, or degeneration. Loss of sensory hair cells in the inner ear involved in hearing loss or vestibular hypofunction may also benefit from the compositions of the invention. In the inner ear, the auditory organ houses mechanosensitive hair cells required for translating sound vibration to electric impulses. The vestibular organs, comprised of the semicircular canals (SSCs), the utricle, and the saccule, also contain sensory hair cells in order to detect head position and motion. Compositions of the present invention can be used, for example, in an infusion; in a matrix or other depot system; or other topical application to the ear for enhancement of auditory regeneration.

A Wnt surrogate molecule may also be used in regeneration of retinal tissue. In the adult mammalian retina, Muller glia cells are capable of regenerating retinal cells, including photoreceptors, for example after neurotoxic injury in vivo. Wnt signaling and enhancers of Wnt signals can promote proliferation of Muller glia-derived retinal progenitors after damage or during degeneration. The compositions of the invention may also be used in the regeneration of tissues and other cell types in the eye. For examples age-related macular degeneration (AMD), other retina degenerative diseases, cornea diseases, Fuchs' dystrophy, vitreoretinopathy, hereditary diseases, etc. can benefit from the compositions of the present inventions. AMD is characterized by progressively decreased central vision and visual acuity. Fuchs' dystrophy is characterized by progressive loss of cornea endothelial cells. Wnt signal and enhancing of Wnt signal can promote regeneration of cornea endothelium, retina epithelium, etc. in the eye tissue. In other embodiments, compositions of the present invention can be used, for example, in an infusion; in a matrix or other depot system; or other topical application to the eye for retinal regeneration and treatment of macular degeneration.

Specific populations of proliferating cells for homeostatic renewal of hepatocytes have been identified through lineage tracing studies, for example Axin2-positive cells in pericentral region. Lineage tracing studies also identified additional potential liver progenitor cells, including but not limited to Lgr-positive cells. The self-renewing liver cells and other populations of potential progenitor cells, including Lgr5-positive and Axin2-positive cells, are identified to be capable of regeneration responding to Wnt signals and/or R-spondins following injuries. Numerous preclinical models of acute liver injury and failure and chronic liver diseases showed recovery and regeneration of hepatocytes benefit from enhancing Wnt signals.

In certain embodiments, compositions comprising a Wnt surrogate molecule disclosed herein (or a polynucleotide encoding a Wnt surrogate molecule, or a vector or cell comprising a polynucleotide encoding a Wnt surrogate molecule) are used to promote liver regeneration, reduce fibrosis, and/or improve liver function. In certain embodiments, compositions and methods disclosed herein are used to: increase liver weight, increase the liver to body weight ratio, increase the number of PCNA and pH3 positive nuclei in liver, increase expression of Ki67 and/or Cyclin D1 in liver, increase liver cell proliferation and/or mitosis, decrease fibrosis following chronic liver injury, or increase hepatocyte function.

In particular embodiments, the compositions of this invention may be used in treatment of acute liver failure, acute alcoholic liver injuries, treatment of chronic liver diseases with hepatitis C or B virus infection or post-antiviral drug therapies, chronic alcoholic liver diseases, alcoholic hepatitis, non-alcoholic fatty liver diseases and non-alcoholic steatohepatitis (NASH), treatment of cirrhosis and severe chronic liver diseases of all causes, and enhanced regeneration of liver cells. Methods for regeneration of liver tissue benefit from administration of the compounds of the invention, which can be systemic or localized. These include, but are not limited to, methods of systemic administration and methods of localized administration e.g. by injection into the liver tissue, by injection into veins or blood vessels leading into the liver, by implantation of a sustained release formulation, and the like.

In particular embodiments, compositions comprising a Wnt surrogate molecule disclosed herein (or a polynucleotide encoding a Wnt surrogate molecule, or a vector or cell comprising a polynucleotide encoding a Wnt surrogate molecule) are used to treat or prevent a liver disease or disorder, including but not limited to, or to treat or prevent a liver injury or disorder resulting from any of the following: acute liver failure (all causes), chronic liver failure (all causes), cirrhosis, liver fibrosis (all causes), portal hypertension, alcoholic liver diseases including alcoholic hepatitis, nonalcoholic steatohepatisis (NASH), nonalcoholic fatty liver disease (NAFLD) (fatty liver), alcoholic hepatitis, hepatitis C virus-induced liver diseases (HCV), hepatitis B virus-induced liver diseases (HBV), other viral hepatitis (e.g., hepatitis A virus-induced liver diseases (HAV) and hepatitis D virus-induced liver diseases (HDV)), primary biliary cirrhosis, autoimmune hepatitis, livery surgery, liver injury, liver transplantation, "small for size" syndrome in liver surgery and transplantation, congenital liver disease and disorders, any other liver disorder or detect resulting from genetic diseases, degeneration, aging, drugs, or injuries.

Wnt signals play an important role in regeneration of various epithelial tissues. Various epidermal conditions benefit from treatment with the compounds of the present invention. Mucositis occurs when there is a breakdown of the rapidly divided epithelial cells lining the gastro-intestinal tract, leaving the mucosal tissue open to ulceration and infection. The part of the epithelial lining that covers the mouth, called the oral mucosa, is one of the most sensitive parts of the body and is particularly vulnerable to chemotherapy and radiation. Oral mucositis is probably the most common, debilitating complication of cancer treatments, particularly chemotherapy and radiation. In addition, the compositions of the invention may also benefit treatment of short bowel syndrome, inflammatory bowel diseases (IBD), or other gastrointestinal disorders. Other epidermal conditions include epidermal wound healing, diabetic foot ulcers, syndromes involving tooth, nail, or dermal hypoplasia, and the like. Molecules of the present invention may be used in all these conditions, where regenerative cells are contacted with compounds of the invention. Methods for regeneration of epithelial tissues benefit from administration of the compounds of the invention, which can be systemic or localized. Contacting can be, for example, topical, including intradermal, subdermal, in a gel, lotion, cream etc. applied at targeted site, etc.

In addition to skin and gastrointestinal tract, Wnt signals and enhancement and promotion of Wnt signals also play an important role in repair and regeneration of tissues including pancreas, kidney, and lung in preclinical models. A Wnt surrogate molecule may benefit various disease conditions involving exocrine and endocrine pancreas, kidney, or lung. The Wnt surrogate molecules may be used in treatment of metabolic syndrome; treatment of diabetes, treatment of acute or chronic pancreatitis, exocrine pancreatic insufficiency, treatment of acute kidney injuries, chronic kidney diseases, treatment of lung diseases, including but not limited to chronic obstructive pulmonary diseases (COPD), pulmonary fibrosis, in particular idiopathic pulmonary fibrosis (IPF), and other conditions that cause loss of lung epithelial tissues. Methods for regeneration of these tissues benefit from administration of the compounds of the invention, which can be systemic or localized.

Epidermal Wnt signaling, in coordination with signaling via other development factors, is critical for adult hair follicle regeneration. Hair loss is a common problem, and androgenetic alopecia, often called male pattern baldness, is the most common form of hair loss in men. In some embodiments, hair follicle regeneration is enhanced by contacting a responsive cell population with a molecule of the present invention. In some such embodiments, the contacting is performed in vivo. In other such embodiments, the contacting is performed ex vivo. The molecule may be localized to the site of action, e.g. topical lotions, gels, creams and the like.

Stroke, traumatic brain injury, Alzheimer's disease, multiple sclerosis and other conditions affecting the blood brain barrier (BBB) may be treated with a Wnt surrogate molecule. Angiogenesis is critical to ensure the supply of oxygen and nutrients to many tissues throughout the body, and is especially important for the CNS as the neural tissue is extremely sensitive to hypoxia and ischemia. CNS endothelial cells which form the BBB differ from endothelial cells in non-neural tissue, in that they are highly polarized cells held together by tight junctions and express specific transporters. Wnt signaling regulates CNS vessel formation and/or function. Conditions in which the BBB is compromised can benefit from administration of the compounds of the invention, which can be systemic or localized e.g. by direct injection, intrathecal administration, implantation of sustained release formulations, and the like. In addition, Wnt signal is actively involved in neurogenesis and plays a role of neuroprotection following injury. The compositions of the present invention may also be used in treatment of spinal cord injuries, other spinal cord diseases, stroke, traumatic brain injuries, etc.

Wnt signals also play a role in angiogenesis. A Wnt surrogate molecule may benefit conditions where angiogenesis is beneficial, treatment of myocardial infarction, coronary artery disease, heart failure, diabetic retinopathy, etc., and conditions from hereditary diseases. Methods for regeneration of these tissues benefit from administration of the compounds of the invention, which can be systemic or localized.

In certain embodiments, methods of the present invention promote tissue regeneration, e.g., in a tissue subjected to damage or tissue or cell reduction or loss. The loss or damage can be anything which causes the cell number to diminish, including diseases or injuries. For example, an accident, an autoimmune disorder, a therapeutic side-effect or a disease state could constitute trauma. Tissue regeneration increases the cell number within the tissue and preferably enables connections between cells of the tissue to be re-established, and more preferably the functionality of the tissue to be regained.

The terms "administering" or "introducing" or "providing", as used herein, refer to delivery of a composition to a cell, to cells, tissues and/or organs of a subject, or to a subject. Such administering or introducing may take place in vivo, in vitro or ex vivo.

In particular embodiments, a pharmaceutical composition is administered parenterally, e.g., intravenously, orally, rectally, or by injection. In some embodiments, it is administered locally, e.g., topically or intramuscularly. In some embodiments, a composition is administered to target tissues, e.g., to bone, joints, ear tissue, eye tissue, gastrointestinal tract, skin, a wound site or spinal cord. Methods of the invention may be practiced in vivo or ex vivo. In some embodiments, the contacting of a target cell or tissue with a Wnt surrogate molecule is performed ex vivo, with subsequent implantation of the cells or tissues, e.g., activated stem or progenitor cells, into the subject. The skilled artisan can determine an appropriate site of and route of administration based on the disease or disorder being treated.

The dose and dosage regimen may depend upon a variety of factors readily determined by a physician, such as the nature of the disease or disorder, the characteristics of the subject, and the subject's history. In particular embodiments, the amount of a Wnt surrogate molecule administered or provided to the subject is in the range of about 0.01 mg/kg to about 50 mg/kg, 0.1 mg/kg to about 500 mg/kg, or about 0.1 mg/kg to about 50 mg/kg of the subject's body weight.

The terms "treatment", "treating" and the like are used herein to generally mean obtaining a desired pharmacologic and/or physiological effect. The effect may be prophylactic in terms of completely or partially preventing a disease or symptom thereof, e.g. reducing the likelihood that the disease or symptom thereof occurs in the subject, and/or may be therapeutic in terms of a partial or complete cure for a disease and/or adverse effect attributable to the disease. "Treatment" as used herein covers any treatment of a disease in a mammal, and includes: (a) preventing the disease from occurring in a subject which may be predisposed to the disease but has not yet been diagnosed as having it; (b) inhibiting the disease, i.e., arresting its development; or (c) relieving the disease, i.e., causing regression of the disease. The therapeutic agent (e.g., a Wnt surrogate molecule) may be administered before, during or after the onset of disease or injury. The treatment of ongoing disease, where the treatment stabilizes or reduces the undesirable clinical symptoms of the patient, is of particular interest. Such treatment is desirably performed prior to complete loss of function in the affected tissues. The subject therapy will desirably be administered during the symptomatic stage of the disease, and in some cases after the symptomatic stage of the disease. In some embodiments, the subject method results in a therapeutic benefit, e.g., preventing the development of a disorder, halting the progression of a disorder, reversing the progression of a disorder, etc. In some embodiments, the subject method comprises the step of detecting that a therapeutic benefit has been achieved. The ordinarily skilled artisan will appreciate that such measures of therapeutic efficacy will be applicable to the particular disease being modified, and will recognize the appropriate detection methods to use to measure therapeutic efficacy.

Other embodiments relate, in part, to the use of the Wnt surrogate molecules disclosed herein to promote or enhance the growth or proliferation of cells, tissues and organoids, for example, by contacting cells or tissue with one or more Wnt surrogate, optionally in combination with a Norrin or Rspondin polypeptide. In certain embodiments, the cells or tissue are contacted ex vivo, in vitro, or in vivo. Such methods may be used to generate cells, tissue or organoids for therapeutic use, e.g., to be transplanted or grafted into a subject. They may also be used to generate cells, tissue or organoids for research use. The Wnt surrogate molecules have widespread applications in non-therapeutic methods, for example in vitro research methods.

The invention provides a method for tissue regeneration of damaged tissue, such as the tissues discussed above, comprising administering a Wnt surrogate molecule to cells. The Wnt surrogate molecule may be administered directly to the cells in vivo, administered to a subject orally, intravenously, or by other methods known in the art, or administered to ex vivo cells. In some embodiments where the Wnt surrogate molecule is administered to ex vivo cells, these cells may be transplanted into a subject before, after or during administration of the Wnt surrogate molecule.

Wnt signaling is a key component of stem cell culture. For example, the stem cell culture media as described in WO2010/090513, WO2012/014076, Sato et al., 2011 (GASTROENTEROLOGY 2011; 141: 1762-1772) and Sato et al., 2009 (Nature 459, 262-5). The Wnt surrogate molecules disclosed herein are suitable alternatives to Rspondin for use in these stem cell culture media, or may be combined with Rspondin.

Accordingly, in one embodiment, the disclosure provides a method for enhancing the proliferation of stem cells comprising contacting stem cells with one or more Wnt surrogate molecules disclosed herein. In one embodiment, the disclosure provides a cell culture medium comprising one or more Wnt surrogate molecules disclosed herein. In some embodiments, the cell culture medium may be any cell culture medium already known in the art that normally comprises Wnt or Rspondin, but wherein the Wnt or Rspondin is replaced (wholly or partially) or supplemented by Wnt surrogate molecule(s) disclosed herein. For example, the culture medium may be as described in as described in WO2010/090513, WO2012/014076, Sato et al., 2011 (GASTROENTEROLOGY 2011; 141: 1762-1772) and Sato et al., 2009 (Nature 459, 262-5), which are hereby incorporated by reference in their entirety.

Stem cell culture media often comprise additional growth factors. This method may thus additionally comprise supplying the stem cells with a growth factor. Growth factors commonly used in cell culture medium include epidermal growth factor (EGF, (Peprotech), Transforming Growth Factor-alpha (TGF-alpha, Peprotech), basic Fibroblast Growth Factor (bFGF, Peprotech), brain-derived neurotrophic factor (BDNF, R&D Systems), Hepatocyte Growth Factor (HGF) and Keratinocyte Growth Factor (KGF, Peprotech, also known as FGF7). EGF is a potent mitogenic factor for a variety of cultured ectodermal and mesodermal cells and has a profound effect on the differentiation of specific cells in vivo and in vitro and of some fibroblasts in cell culture. The EGF precursor exists as a membrane-bound molecule which is proteolytically cleaved to generate the 53-amino acid peptide hormone that stimulates cells. EGF or other mitogenic growth factors may thus be supplied to the stem cells. During culturing of stem cells, the mitogenic growth factor may be added to the culture medium every second day, while the culture medium is refreshed preferably every fourth day. In general, a mitogenic factor is selected from the groups consisting of: i) EGF, TGF-alpha, and KGF, ii) EGF, TGF-alpha, and FGF7; iii) EGF, TGF-alpha, and FGF; iv) EGF and KGF; v) EGF and FGF7; vi) EGF and a FGF; vii) TGF-alpha and KGF; viii) TGF-alpha, and FGF7; ix) or from TGF-alpha and a FGF. In certain embodiments, the disclosure includes a stem cell culture media comprising a Wnt surrogate molecule disclosed herein, e.g., optionally in combination with one or more of the growth factors or combinations thereof described herein.

These methods of enhancing proliferation of stem cells can be used to grow new organoids and tissues from stem cells, as for example described in WO2010/090513 WO02012/014076, Sato et al., 2011 (GASTROENTEROLOGY 2011; 141: 1762-1772) and Sato et al., 2009 (Nature 459, 262-5).

In some embodiments, the Wnt surrogate molecules are used to enhance stem cell regeneration. Illustrative stem cells of interest include but are not limited to: muscle satellite cells; hematopoietic stem cells and progenitor cells derived therefrom (U.S. Pat. No. 5,061,620); neural stem cells (see Morrison et al. (1999) Cell 96: 737-749); embryonic stem cells: mesenchymal stem cells; mesodermal stem cells; liver stem cells; adipose-tissue derived stem cells, etc.

Other embodiments of the present invention relate, in part, to diagnostic applications for detecting the presence of cells or tissues expressing one or more Fzd receptors or LRP5 or LRP6 receptors. Thus, the present disclosure provides methods of detecting one or more Fzd receptor or LRP5 or LRP6 receptor in a sample, such as detection of cells or tissues expressing Fzd1. Such methods can be applied in a variety of known detection formats, including, but not limited to immunohistochemistry (IHC), immunocytochemistry (ICC), in situ hybridization (ISH), whole-mount in situ hybridization (WISH), fluorescent DNA in situ hybridization (FISH), flow cytometry, enzyme immunoassay (EIA), and enzyme linked immuno-assay (ELISA), e.g., by detecting binding of a Wnt surrogate molecule.

ISH is a type of hybridization that uses a labeled complementary DNA or RNA strand (i.e., primary binding agent) to localize a specific DNA or RNA sequence in a portion or section of a cell or tissue (in situ), or if the tissue is small enough, the entire tissue (whole mount ISH). One having ordinary skill in the art would appreciate that this is distinct from immunohistochemistry, which localizes proteins in tissue sections using an antibody as a primary binding agent. DNA ISH can be used on genomic DNA to determine the structure of chromosomes. Fluorescent DNA ISH (FISH) can, for example, be used in medical diagnostics to assess chromosomal integrity. RNA ISH (hybridization histochemistry) is used to measure and localize mRNAs and other transcripts within tissue sections or whole mounts.

In various embodiments, the Wnt surrogate molecules described herein are conjugated to a detectable label that may be detected directly or indirectly. In this regard, an antibody "conjugate" refers to a Wnt surrogate molecule that is covalently linked to a detectable label. In the present invention, DNA probes, RNA probes, monoclonal antibodies, antigen-binding fragments thereof, and antibody derivatives thereof, such as a single-chain-variable-fragment antibody or an epitope tagged antibody, may all be covalently linked to a detectable label. In "direct detection", only one detectable antibody is used, i.e., a primary detectable antibody. Thus, direct detection means that the antibody that is conjugated to a detectable label may be detected, per se, without the need for the addition of a second antibody (secondary antibody).

A "detectable label" is a molecule or material that can produce a detectable (such as visually, electronically or otherwise) signal that indicates the presence and/or concentration of the label in a sample. When conjugated to an antibody, the detectable label can be used to locate and/or quantify the target to which the specific antibody is directed. Thereby, the presence and/or concentration of the target in a sample can be detected by detecting the signal produced by the detectable label. A detectable label can be detected directly or indirectly, and several different detectable labels conjugated to different specific-antibodies can be used in combination to detect one or more targets.

Examples of detectable labels, which may be detected directly, include fluorescent dyes and radioactive substances and metal particles. In contrast, indirect detection requires the application of one or more additional antibodies, i.e., secondary antibodies, after application of the primary antibody. Thus, the detection is performed by the detection of the binding of the secondary antibody or binding agent to the primary detectable antibody. Examples of primary detectable binding agents or antibodies requiring addition of a secondary binding agent or antibody include enzymatic detectable binding agents and hapten detectable binding agents or antibodies.

In some embodiments, the detectable label is conjugated to a nucleic acid polymer which comprises the first binding agent (e.g., in an ISH, WISH, or FISH process). In other embodiments, the detectable label is conjugated to an antibody which comprises the first binding agent (e.g., in an IHC process).

Examples of detectable labels which may be conjugated to Wnt surrogate molecules used in the methods of the present disclosure include fluorescent labels, enzyme labels, radioisotopes, chemiluminescent labels, electrochemiluminescent labels, bioluminescent labels, polymers, polymer particles, metal particles, haptens, and dyes.

Examples of fluorescent labels include 5-(and 6)-carboxyfluorescein, 5- or 6-carboxyfluorescein, 6-(fluorescein)-5-(and 6)-carboxamido hexanoic acid, fluorescein isothiocyanate, rhodamine, tetramethylrhodamine, and dyes such as Cy2, Cy3, and Cy5, optionally substituted coumarin including AMCA, PerCP, phycobiliproteins including R-phycoerythrin (RPE) and allophycoerythrin (APC), Texas Red, Princeton Red, green fluorescent protein (GFP) and analogues thereof, and conjugates of R-phycoerythrin or allophycoerythrin, inorganic fluorescent labels such as particles based on semiconductor material like coated CdSe nanocrystallites.

Examples of polymer particle labels include micro particles or latex particles of polystyrene, PMMA or silica, which can be embedded with fluorescent dyes, or polymer micelles or capsules which contain dyes, enzymes or substrates.

Examples of metal particle labels include gold particles and coated gold particles, which can be converted by silver stains. Examples of haptens include DNP, fluorescein isothiocyanate (FITC), biotin, and digoxigenin. Examples of enzymatic labels include horseradish peroxidase (HRP), alkaline phosphatase (ALP or AP), β-galactosidase (GAL), glucose-6-phosphate dehydrogenase, β-N-acetylglucosamimidase, β-glucuronidase, invertase, Xanthine Oxidase, firefly luciferase and glucose oxidase (GO). Examples of commonly used substrates for horseradishperoxidase include 3,3'-diaminobenzidine (DAB), diaminobenzidine with nickel enhancement, 3-amino-9-ethylcarbazole (AEC), Benzidine dihydrochloride (BDHC), Hanker-Yates reagent (HYR), Indophane blue (IB), tetramethylbenzidine (TMB), 4-chloro-1-naphtol (CN), .alpha.-naphtol pyronin (.alpha.-NP), o-dianisidine (OD), 5-bromo-4-chloro-3-indolylphosphate (BCIP), Nitro blue tetrazolium (NBT), 2-(p-iodophenyl)-3-p-nitrophenyl-5-phenyl tetrazolium chloride (INT), tetranitro blue tetrazolium (TNBT), 5-bromo-4-chloro-3-indoxyl-beta-D-galactoside/ferro-ferricyanide (BCIG/FF).

Examples of commonly used substrates for Alkaline Phosphatase include Naphthol-AS-B 1-phosphate/fast red TR (NABP/FR), Naphthol-AS-MX-phosphate/fast red TR (NAMP/FR), Naphthol-AS-B1-phosphate/-fast red TR (NABP/FR), Naphthol-AS-MX-phosphate/fast red TR (NAMP/FR), Naphthol-AS-B1-phosphate/new fuschin (NABP/NF), bromochloroindolyl phosphate/nitroblue tetrazolium (BCIP/NBT), 5-Bromo-4-chloro-3-indolyl-b-d-galactopyranoside (BCIG).

Examples of luminescent labels include luminol, isoluminol, acridinium esters, 1,2-dioxetanes and pyridopyridazines. Examples of electrochemiluminescent labels include ruthenium derivatives. Examples of radioactive labels include radioactive isotopes of iodide, cobalt, selenium, tritium, carbon, sulfur and phosphorous.

Detectable labels may be linked to the antibodies described herein or to any other molecule that specifically binds to a biological marker of interest, e.g., an antibody, a nucleic acid probe, or a polymer. Furthermore, one of ordinary skill in the art would appreciate that detectable labels can also be conjugated to second, and/or third, and/or fourth, and/or fifth binding agents or antibodies, etc. Moreover, the skilled artisan would appreciate that each additional binding agent or antibody used to characterize a biological marker of interest may serve as a signal amplification step. The biological marker may be detected visually using, e.g., light microscopy, fluorescent microscopy, electron microscopy where the detectable substance is for example a dye, a colloidal gold particle, a luminescent reagent. Visually detectable substances bound to a biological marker may also be detected using a spectrophotometer. Where the detectable substance is a radioactive isotope detection can be visually by autoradiography, or non-visually using a scintillation counter. See, e.g., Larsson, 1988, Immunocytochemistry: Theory and Practice, (CRC Press, Boca Raton, Fla.); Methods in Molecular Biology, vol. 80 1998, John D. Pound (ed.) (Humana Press, Totowa, N.J.).

The invention further provides kits for detecting one or more Fzd or LRP5/6 receptor or cells or tissues expressing one or more Fzd or LRP5/6 receptors in a sample, wherein the kits contain at least one antibody, polypeptide, polynucleotide, vector or host cell as described herein. In certain embodiments, a kit may comprise buffers, enzymes, labels, substrates, beads or other surfaces to which the antibodies of the invention are attached, and the like, and instructions for use.

All of the above U.S. patents, U.S. patent application publications, U.S. patent applications, foreign patents, foreign patent applications and non-patent publications referred to in this specification and/or listed in the Application Data Sheet, are incorporated herein by reference, in their entirety.

From the foregoing it will be appreciated that, although specific embodiments of the invention have been described herein for purposes of illustration, various modifications may be made without deviating from the spirit and scope of the invention. Accordingly, the invention is not limited except as by the appended claims.

EXAMPLES

Example 1

Illustrative Wnt Surrogate Molecule Formats

Wnt surrogates having a variety of different formats disclosed herein were made. These included the following illustrative formats, each comprising a binding domain ("binder") that binds to one or more Fzd receptor and a binding domain ("binder") that binds to an LRP5 and/or LRP6 receptor.

As shown in FIG. 1A, if a binder to one receptor is a Fab and to the other receptor is a Nab or scFv, they can be put together in several different configurations. In certain instances, the Fab binder first can be reformatted to a full IgG format, then the Nab binder can be fused to any of the 4 available termini of the IgG. For example, the Nab can be fused to the N-terminus of the IgG light chain (LC, the fusion will be referred to as NL, shown in top left), N-terminus of the IgG heavy chain (HC, the fusion will be referred to as NH, shown in top right), the C-terminus of LC (the fusion will be referred to as CL, shown in middle right), and the C-terminus of HC (the fusion will be referred to as CH, shown in middle left). The linkers and the length of the linkers between the IgG and the Nab can be varied. These four formats are bispecific and bivalent, they are bivalent binders toward each of the receptors. An alternative way to put the two binders together is the Hetero-Ig format where the Fab binder is presented as a half antibody, and the Nab is fused to the N-terminus of an Fc (shown in lower middle). The two halves may be brought together by mutations in the CH3 domain (such as the knobs-into-holes) that favor the formation of the heterodimer. The linker and its length between the Nab binder and the Fc can be varied. This format would be bispecific but monovalent toward each receptor. The Nab part of any of the formats described in this example can also be replaced by scFv fragments of binders as well.

As shown in FIG. 1B, if a binder to one receptor is a Fab and to the other receptor is also a Fab, they can be put together in several different configurations. In one approach, one Fab binder is first reformatted to a full IgG format (shown in top). The second Fab binder can be fused to the N-terminus of the IgG. The two HC can be fused together with a linker in between. The LCs can be fused or unfused. The linker and its length can be varied. This format is a bispecific and bivalent format. Alternatively, the second Fab binder LC can be fused to the HC of the IgG with a linker of various length in between. The second Fab binder HC can be fused or unfused to the LC of the IgG. A variation of this format has been called Fabs-in-tandem IgG (or FIT-Ig). In another approach, the two binders can be brought together as a Hetero-Ig by mutations in the CH3 domain that favors the heterodimer assembly, the two arms will each bind to one receptor (shown in bottom). This format is a bispecific and monovalent binder.

As shown in FIG. 1C, if a binder to one receptor is a Nab and to the other receptor is also a Nab, they can be put together in several different configurations. In the bispecific bivalent formats, in certain instances, the two Nab binders can be fused together in tandem (shown in top row) or fused to the two-different ends of the Fc (shown in middle row). The linker and its length between Nab and Nab or Nab and Fc can be varied. Alternatively, the two Nabs can be assembled together as Hetero-Ig to generate a bispecific and monovalent format (shown in bottom row). Similar to FIG. 1A, the Nab domains here can also be replaced by an scFv domain of a binder. In all the examples, the Nab and scFv can be mixed in certain combinations as well.

As shown in FIG. 1D, the binders against Fzd and LRP can also be linked together in a diabody (or DART) configuration. The diabody can also be in a single chain configuration. If the diabody is fused to an Fc, this will create a bivalent bispecific format. Without fusion to Fc, this would be a monovalent bispecific format.

A number of Wnt surrogates representing different configurations were produced. These included the Wnt surrogates described in Table 3. These illustrative Wnt surrogates include one, two or three polypeptides, the sequences of which are provided as Sequence 1, Sequence 2, and/or Sequence 3. The sequence may include a leader peptide sequence, a Nab sequence, a linker, and/or a heavy or light chain sequence. Annotated sequences are provided in FIG. 19, in which the leader peptide sequence is italicized, the linker sequence is underlined, the Nab sequence is shown in bold, and the remaining sequence is the heavy chain or light chain sequence. The Fzd binder IDs and LRP binder IDs correspond to the clone numbers provided in Tables 1A-B and 2A-B for various Fzd binding or LRP5/6 binding antibodies or antigen-binding fragments thereof.

The Wnt surrogates beginning with "R2M3" include different LRP6 binding domains fused to the N-terminus of a light chain region of the anti-Fzd antibody or antigen-binding fragment thereof named 001S-A04. The first six Wnt surrogates beginning with "18R5" in Table 3 include different LRP6 binding domains fused to the N-terminus of the anti-Fzd antibody or antigen-binding fragment thereof named 18R5. The Wnt surrogates beginning with "1R" include the anti-LRP6 antibody of antigen-binding fragment thereof named "009S-E04" fused to the N-terminus of different anti-Fzd antibodies or antigen-binding fragment thereof. For "R2M3-26CH," the LRP6 binding region is fused to the C-terminus of the Fzd binding region. For "R2M3-26NH," the LRP6 binding region is fused to the N-terminus of the Fzd binding region. For "R2M3-26CL," the LRP6 binding region is fused to the C-terminus of the Fzd binding region. For "R2M3-26NL," the LRP6 binding region is fused to the N-terminus of the Fzd binding region. For "R2M3-26Fab" and "R2M3-32Fab," the LRP6 binding region is fused to the N-terminus of the Fzd binding region. For "Hetero-Ig," the LRP6 binding region is fused to the N-terminus of human Fc_hole, and paired with Fzd binder light chain and heavy chain human IgG1_knob. The Wnt surrogates beginning with "17SB9" include different LRP6 binding domains fused to the N-terminus of a light chain region of the anti-Fzd antibody or antigen-binding fragment thereof named 017S-B09. The Wnt surrogates beginning with "1R-C07" include different LRP6 binding domains fused to the N-terminus of a light chain region of the anti-Fzd antibody or antigen-binding fragment thereof named 001S-B03. The Wnt surrogates beginning with "R2M13" include different LRP6 binding domains fused to the N-terminus of a light chain region of the anti-Fzd antibody or antigen-binding fragment thereof named 004S-G06. The Wnt surrogates beginning with "3SD10" include different LRP6 binding domains fused to the N-terminus of a light chain region of the anti-Fzd antibody or antigen-binding fragment thereof named 003S-D10. The Wnt surrogates beginning with "4SD1" include different LRP6 binding domains fused to the N-terminus of a light chain region of the anti-Fzd antibody or antigen-binding fragment thereof named 004S-D01. The Wnt surrogates beginning with "14SB6" include different LRP6 binding domains fused to the N-terminus of a light chain region of the anti-Fzd antibody or antigen-binding fragment thereof named 014S-B06.

TABLE 3

Wnt Surrogate Sequences

| Name | Fzd binder ID | LRP binder ID | Sequence 1 SEQ ID NO | Sequence 2 SEQ ID NO | Sequence 3 SEQ ID NO |
| --- | --- | --- | --- | --- | --- |
| R2M3-23 | 001S-A04 | 009S-B04 | 89 | 95 | N/A |
| R2M3-26 | 001S-A04 | 009S-E04 | 90 | 95 | N/A |
| R2M3-28 | 001S-A04 | 009S-G04 | 91 | 95 | N/A |
| R2M3-29 | 001S-A04 | 009S-H04 | 92 | 95 | N/A |
| R2M3-31 | 001S-A04 | 013S-G04 | 93 | 95 | N/A |
| R2M3-32 | 001S-A04 | 013S-H04 | 94 | 95 | N/A |
| 18R5-5 | 18R5 | 008S-G01 | 96 | 104 | N/A |
| 18R5-7 | 18R5 | 008S-C02 | 97 | 104 | N/A |
| 18R5-8 | 18R5 | 008S-D02 | 98 | 104 | N/A |
| 18R5-9 | 18R5 | 008S-E02 | 99 | 104 | N/A |
| 18R5-26 | 18R5 | 009S-E04 | 100 | 104 | N/A |
| 18R5-28 | 18R5 | 009S-G04 | 101 | 104 | N/A |
| 18R5-31 | 18R5 | 013S-G04 | 102 | 104 | N/A |
| 18R5-32 | 18R5 | 013S-H04 | 103 | 104 | N/A |
| 1R-B05-26 | 001S-E02 | 009S-E04 | 105 | 111 | N/A |
| 1R-C01-26 | 001S-B01 | 009S-E04 | 106 | 112 | N/A |
| 1R-C07-26 | 001S-B03 | 009S-E04 | 107 | 113 | N/A |
| 1R-E06-26 | 001S-H02 | 009S-E04 | 108 | 114 | N/A |
| 1R-G05-26 | 001S-G02 | 009S-E04 | 109 | 115 | N/A |
| 1R-G06-26 | 001S-A03 | 009S-E04 | 110 | 116 | N/A |
| R2M3-26CH | 001S-A04 | 009S-E04 | 125 | 117 | N/A |

TABLE 3-continued

Wnt Surrogate Sequences

| Name | Fzd binder ID | LRP binder ID | Sequence 1 SEQ ID NO | Sequence 2 SEQ ID NO | Sequence 3 SEQ ID NO |
|---|---|---|---|---|---|
| R2M3-26NH | 001S-A04 | 009S-E04 | 125 | 118 | N/A |
| R2M3-26CL | 001S-A04 | 009S-E04 | 119 | 2254 | N/A |
| R2M3-26NL | 001S-A04 | 009S-E04 | 120 | 2254 | N/A |
| R2M3-26Fab | 001S-A04 | 009S-E04 | 120 | 122 | N/A |
| R2M3-26F(ab')2 | 001S-A04 | 009S-E04 | 120 | 2252 | |
| R2M3-32Fab | 001S-A04 | 013S-H04 | 123 | 122 | N/A |
| R2M3-26Hetero-Ig | 001S-A04 | 009S-E04 | 125 | 126 | 127 |
| 26-17SB9 | 017S-B09 | 009S-E04 | 128 | N/A | N/A |
| 26:Fc:17SB9-criss-cross | 017S-B09 | 009S-E04 | 2192 | 2193 | N/A |
| 26:5:17SB9:Fc | 017S-B09 | 009S-E04 | 2194 | N/A | N/A |
| 26:10:17SB9:Fc | 017S-B09 | 009S-E04 | 2195 | N/A | N/A |
| 26:15:17SB9: Fc | 017S-B09 | 009S-E04 | 2196 | N/A | N/A |
| 17SB9:Fc:26 | 017S-B09 | 009S-E04 | 2197 | N/A | N/A |
| 26:Fc:26+17SB9:Fc:17SB9 | 017S-B09 | 009S-E04 | 2198 | 2199 | N/A |
| 1R-C07-3 | 001S-B03 | 008S-D01 | 134 | 113 | N/A |
| 1R-C07-36 | 001S-B03 | 013S-D05 | 135 | 113 | N/A |
| R2M13-3 | 004S-G06 | 008S-D01 | 136 | 153 | N/A |
| R2M13-26 | 004S-G06 | 009S-E04 | 137 | 153 | N/A |
| R2M13-36 | 004S-G06 | 013S-D05 | 138 | 153 | N/A |
| R2M3-3 | 001S-A04 | 008S-D01 | 139 | 2254 | N/A |
| R2M3-36 | 001S-A04 | 013S-D05 | 140 | 2254 | N/A |
| 3SD10-3 | 003S-D10 | 008S-D01 | 141 | 154 | N/A |
| 3SD10-26 | 003S-D10 | 009S-E04 | 142 | 154 | N/A |
| 3SD10-36 | 003S-D10 | 013S-D05 | 143 | 154 | N/A |
| 4SD1-3 | 004S-D01 | 008S-D01 | 144 | 155 | N/A |
| 4SD1-26 | 004S-D01 | 009S-E04 | 145 | 155 | N/A |
| 4SD1-36 | 004S-D01 | 013S-D05 | 146 | 155 | N/A |
| 14SB6-3 | 014S-B06 | 008S-D01 | 147 | 156 | N/A |
| 14SB6-26 | 014S-B06 | 009S-E04 | 148 | 156 | N/A |
| 14SB6-36 | 014S-B06 | 013S-D05 | 149 | 156 | N/A |
| R2M9-3 | 003S-E07 | 008S-D01 | 150 | 157 | N/A |
| R2M9-26 | 003S-E07 | 009S-E04 | 151 | 157 | N/A |
| R2M9-36 | 003S-E07 | 013S-D05 | 152 | 157 | N/A |
| 18R5:5:1115.3:Fc | 18R5 | 1115.3 | 2200 | N/A | N/A |
| 18R5:10:1115.3:Fc | 18R5 | 1115.3 | 2201 | N/A | N/A |
| 18R5:15:1115.3:Fc | 18R5 | 1115.3 | 2202 | N/A | N/A |
| 1115.3:5:18R5:Fc | 18R5 | 1115.3 | 2203 | N/A | N/A |
| 1115.3:10:18R5:Fc | 18R5 | 1115.3 | 2204 | N/A | N/A |
| 1115.3:15:18R5:Fc | 18R5 | 1115.3 | 2205 | N/A | N/A |
| 18R5:5:YW211.31.57:Fc | 18R5 | YW211.31.57 | 2206 | N/A | N/A |
| 18R5:10:YW211.31.57:Fc | 18R5 | YW211.31.57 | 2207 | N/A | N/A |
| 18R5:15:YW211.31.57:Fc | 18R5 | YW211.31.57 | 2208 | N/A | N/A |
| YW211.31.57:5:18R5:Fc | 18R5 | YW211.31.57 | 2209 | N/A | N/A |
| YW211.31.57:10:18R5:Fc | 18R5 | YW211.31.57 | 2210 | N/A | N/A |
| YW211.31.57:15:18R5:Fc | 18R5 | YW211.31.57 | 2211 | N/A | N/A |
| 18R5:Fc:1115.3 | 18R5 | 1115.3 | 2212 | N/A | N/A |
| 1115.3:Fc:18R5 | 18R5 | 1115.3 | 2213 | N/A | N/A |
| 18R5:Fc:YW211.31.57 | 18R5 | YW211.31.57 | 2250 | N/A | N/A |
| YW211.31.57:Fc:18R5 | 18R5 | YW211.31.57 | 2267 | N/A | N/A |
| 421.1-R2M3 cp | 001S-A04 | 421.1 | 2214 | 2215 | 2216 |
| 1RC07:5:10SA7 cp | 1RC07 | 10SA7 | 2217 | 2218 | 2219 |
| 1RC07:10:10SA7 cp | 1RC07 | 10SA7 | 2217 | 2218 | 2222 |
| 1RC07:15:10SA7 cp | 1RC07 | 10SA7 | 2217 | 2218 | 2225 |
| 1RC07:5:10SG7 cp | 1RC07 | 10SG7 | 2217 | 2227 | 2228 |
| 1RC07:10:10SG7 cp | 1RC07 | 10SG7 | 2217 | 2227 | 2231 |
| 1RC07:15:10SG7 cp | 1RC07 | 10SG7 | 2217 | 2227 | 2234 |
| 10SG7:5:1RC07 cp | 1RC07 | 10SG7 | 2227 | 2217 | 2237 |
| 10SG7:10:1RC07 cp | 1RC07 | 10SG7 | 2227 | 2217 | 2240 |
| 10SG7:15:1RC07 cp | 1RC07 | 10SG7 | 2227 | 2217 | 2243 |
| 1RC07:5:10SA7 L->H | 1RC07 | 10SA7 | 2244 | 2245 | 2246 |
| 1115.3:5:R2M3 L->H | 001S-A04 | 1115.3 | 2247 | 125 | 2248 |
| 1115.3:10:R2M3 L->H | 001S-A04 | 1115.3 | 2247 | 125 | 2249 |
| 10SG11-1RC07 | 1RC07 | 10SG11 | 2252 | 2253 | N/A |
| 18R5:5:1115.3:His | 18R5 | 1115.3 | 2255 | N/A | N/A |
| 18R5:10:1115.3:His | 18R5 | 1115.3 | 2256 | N/A | N/A |
| 18R5:15:1115.3:His | 18R5 | 1115.3 | 2257 | N/A | N/A |
| 1115.3:5:18R5:His | 18R5 | 1115.3 | 2258 | N/A | N/A |
| 1115.3:10:18R5:His | 18R5 | 1115.3 | 2259 | N/A | N/A |
| 1115.3:15:18R5:His | 18R5 | 1115.3 | 2260 | N/A | N/A |
| 18R5:5:YW211.31.57:His | 18R5 | YW211.31.57 | 2261 | N/A | N/A |
| 18R5:10:YW211.31.57:His | 18R5 | YW211.31.57 | 2262 | N/A | N/A |

TABLE 3-continued

Wnt Surrogate Sequences

| Name | Fzd binder ID | LRP binder ID | Sequence 1 SEQ ID NO | Sequence 2 SEQ ID NO | Sequence 3 SEQ ID NO |
|---|---|---|---|---|---|
| 18R5:15:YW211.31.57:His | 18R5 | YW211.31.57 | 2263 | N/A | N/A |
| YW211.31.57:5:18R5:His | 18R5 | YW211.31.57 | 2264 | N/A | N/A |
| YW211.31.57:10:18R5:His | 18R5 | YW211.31.57 | 2265 | N/A | N/A |
| YW211.31.57:15:18R5:His | 18R5 | YW211.31.57 | 2266 | N/A | N/A |

Example 2

Characterization of a Wnt Surrogate Molecule, R2M3-26

The R2M3-26 molecule consists of a Fzd binder (R2M3) and a LRP6 binder (26). The LRP6 binder 26 was fused to the N-terminus of R2M3 LC with a 5-amino acid linker as depicted in FIG. 2A. R2M3 was in the form of an IgG. The protein was purified by Protein A affinity column followed by a size-exclusion-chromatography (SEC) step. The absorbance trace from the SEC and the SDS-PAGE gels of the SEC fractions were shown in FIG. 2B. The ability of R2M3-26 to activate canonical Wnt signaling was tested in a Wnt responding 293 reporter cell line (293STF). The 293STF reporter activity traces across the SEC fractions were shown in FIG. 2B, the peak of the reporter activity correlated with the peak of the proteins. The peak fraction was further characterized by a dose response in 293STF cells in the absence and presence of R-spondin (FIG. 2D). R2M3-26 induced reporter activity in a dose dependent manner and was enhanced by the presence of R-spondin similar to a natural Wnt ligand, while R2M3 IgG alone without the attachment of the LRP binding arm did not induce reporter activity. The ability of R2M3-26 to interact with its target, a Fzd1 ECD, was performed in Octet interaction assay (FIG. 2C), and the results showed that the fusion of the LRP6 binding arm, 26, did not affect R2M3 interaction with its target, Fzd.

Example 3

Characterization of a Wnt Surrogate Molecule, R2M3-32

Figure 3:
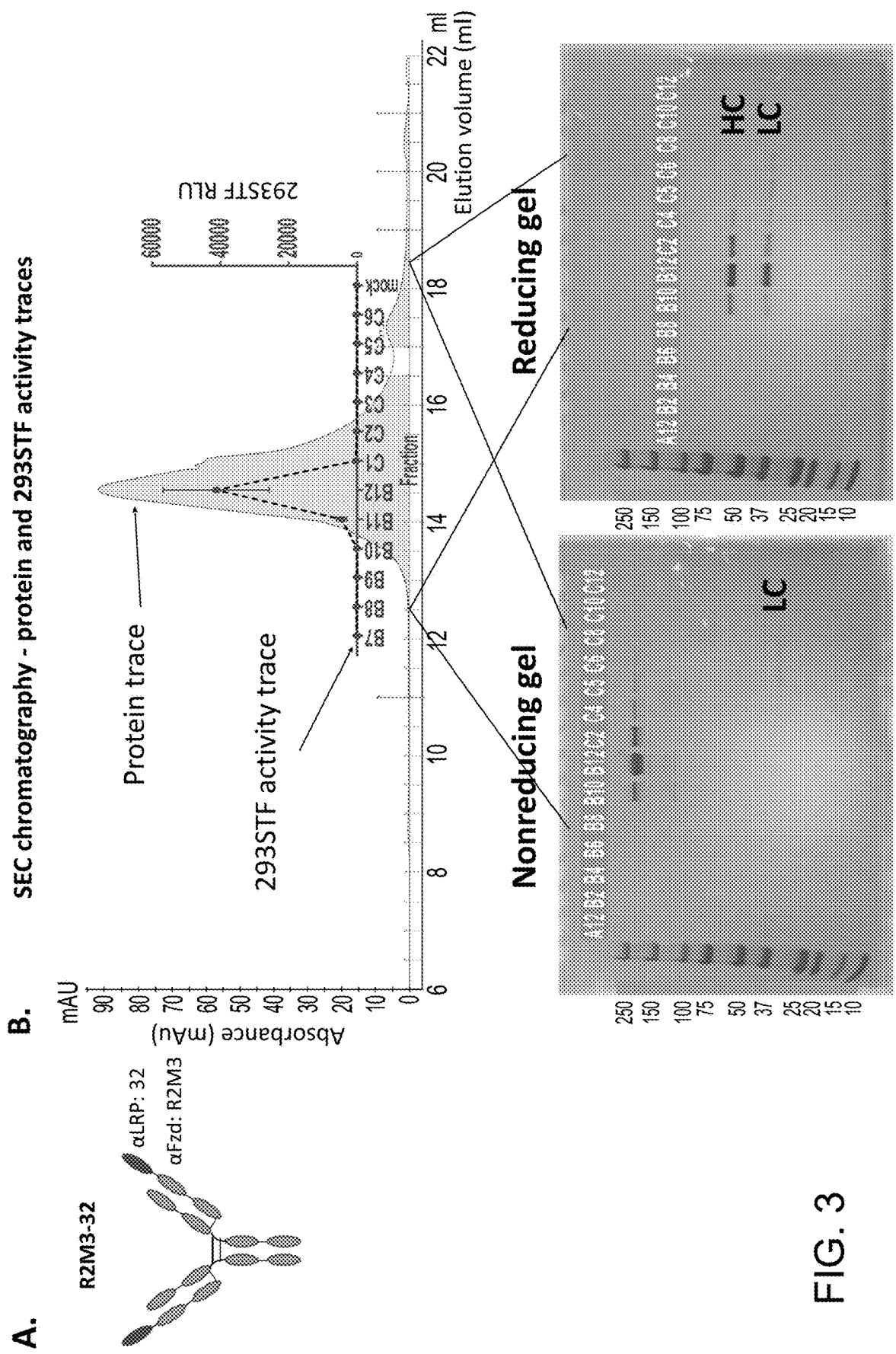
FIGS. 3A-3D. Characterization of a Wnt surrogate molecule, R2M3-32.

The R2M3-32 molecule consists of a Fzd binder (R2M3) and a LRP6 binder (32). The LRP6 binder 32 was fused to the N-terminus of R2M3 LC with a 5-amino acid linker as depicted in FIG. 3A. R2M3 was in the form of an IgG. The protein was purified by Protein A affinity column followed by a size-exclusion-chromatography (SEC) step. The absorbance trace from the SEC and the SDS-PAGE gels of the SEC fractions were shown in FIG. 3B. The ability of R2M3-32 to activate canonical Wnt signaling was tested in a Wnt responding 293 reporter cell line (293STF). The 293STF reporter activity traces across the SEC fractions were shown in FIG. 3B, the peak of the reporter activity correlated with the peak of the proteins. The peak fraction was further characterized by a dose response in 293STF cells in the absence and presence of R-spondin (FIG. 3D). R2M3-32 induced reporter activity in a dose dependent manner and was enhanced by the presence of R-spondin, while R2M3 IgG alone without the attachment of the LRP binding arm did not induce reporter activity. The ability of R2M3-32 to interact with its target, a Fzd1 extracellular domain (ECD), was performed in Octet interaction assay (FIG. 3C). The results showed that the fusion of the LRP6 binding arm, 32, did not affect R2M3 interaction with its target, Fzd.

Example 4

R2M3-26 and R2M3-32 Activities can be Inhibited by Soluble Fzd ECD and by R2M3 IgG Alone without the LRP Binding Arm The ability of soluble Fzd extracellular domain (ECD) or R2M3 IgG alone to inhibit Wnt surrogates was determined using the 293STF reporter assay. The Fzd1 ECD-Fc or R2M3 IgG was titrated into the 293STF reporter assay, at a fixed concentration of R2M3-26 or R2M3-32. In a dose dependent manner, both Fzd1 ECD-Fc and R2M3 IgG inhibited R2M3-26 (FIG. 4A) and R2M3-32 (FIG. 4B) induced reporter signaling, while the negative control molecule, Fc alone had no impact.

Example 5

Characterization of R2M3-LRP6 Binder Fusions in 293, Huh7, A375, BNL.CL2 Wnt Dependent Reporter Assays The Fzd binder, R2M3, was fused to additional LRP6 binders, 23, 25, 26, 27, 28, 29, 31, 32, 33, and 36. The LRP6 binders were Nab and were fused to the N-terminus of R2M3 LC with a 5-amino acid linker. These proteins were purified by Protein A affinity column followed by a SEC step. The fusion proteins were tested in Wnt dependent reporter assays in 293, Huh7, A375, and BNL.CL2 cell lines, and activated Wnt signaling to various levels. R2M3 was also fused to two non-LRP6 binder Nabs, 24 and 34, in the same format as the Lrp6 binders. These two non-binders displayed no activity in Wnt dependent 293 reporter assay (FIG. 5), suggesting that Wnt activities observed with R2M3 fusions to 23, 25, 26, 27, 28, 29, 31, 32, 33, and 36 are dependent on the presence of both Fzd and Lrp mimicking the nature ligand function.

Example 6

Figure 6:
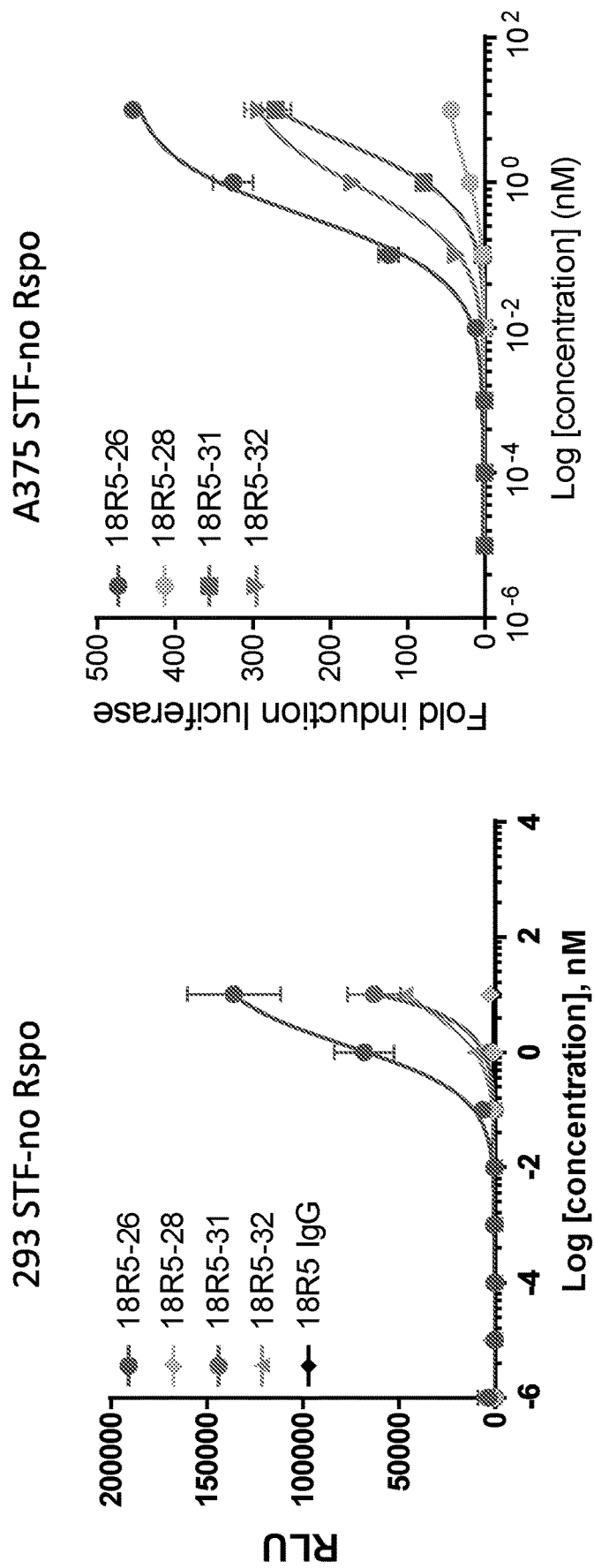
FIG. 6. Characterization of illustrative 18R5-Lrp6 binder fusions in 293, A375, and BNL.CL2 Wnt dependent reporter assays.

Characterization of 18R5-LRP6 Binder Fusions in 293, A375, and BNL.CL2 Wnt Dependent Reporter Assays The Fzd binder, 18R5, was fused to LRP6 binders, 26, 28, 31, 32. The LRP6 binders were Nab and were fused to the N-terminus of 18R5 LC with a 5-amino acid linker. These proteins were purified by Protein A affinity column followed by a SEC step. The fusion proteins were tested in Wnt dependent reporter assays in 293, A375, and BNL.CL2 cell lines and demonstrated ability to activate Wnt signaling (FIG. 6).

Example 7

Figure 7:
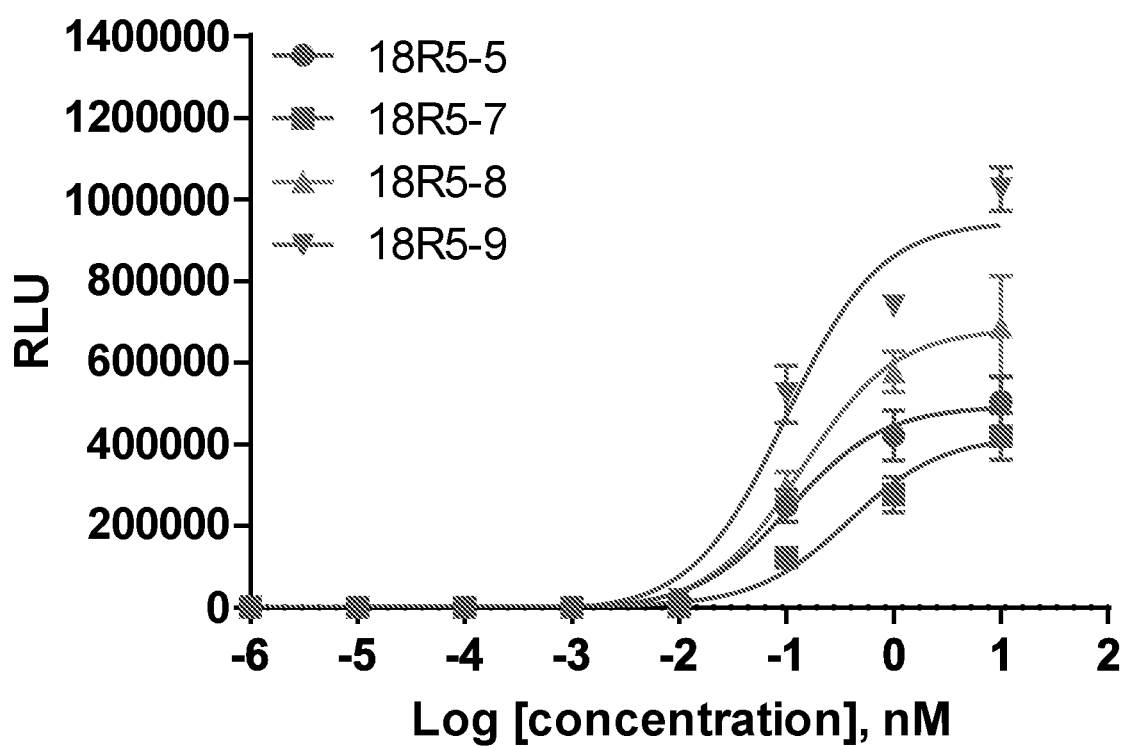
FIG. 7. Characterization of illustrative 18R5-Lrp5 binder fusions in 293 Wnt dependent reporter assays.

Characterization of 18R5-LRP5 Binder Fusions in 293 Wnt Dependent Reporter Assays The Fzd binder, 18R5, was fused to LRP5 binders, 5, 7, 8, 9. The LRP5 binders were Nab and were fused to the N-terminus of 18R5 LC with a 5-amino acid linker. These proteins were purified by Protein A affinity column followed by a SEC step. The fusion proteins were tested in a Wnt dependent reporter assays in 293 cells and were able to activate Wnt signaling (FIG. 7).

Example 8

Characterization of Various Fzd Binders-LRP6 Binder 26 Fusions in 293 Wnt Dependent Reporter Assays The various Fzd binders, 1R-B05, 1R-C01, 1R-C07, 1R-E01, 1R-E06, 1R-G05, 1R-G06, 1R-H04, in IgG format were fused to LRP6 binders, 26. The LRP6 binder Nab was fused to the N-terminus of various Fzd binder LC with a 5-amino acid linker. These proteins were purified by Protein A affinity column followed by a SEC step. The SDS-PAGE gel analysis of the SEC peak fractions were shown in FIG. 8A. The fusion proteins were tested in a Wnt dependent reporter assays in 293 cells in the presence of Rspo and were able to activate Wnt signaling (FIG. 8B).

Example 9

SAR Analysis of the IgG-Nab Fusion Format

Figure 9:
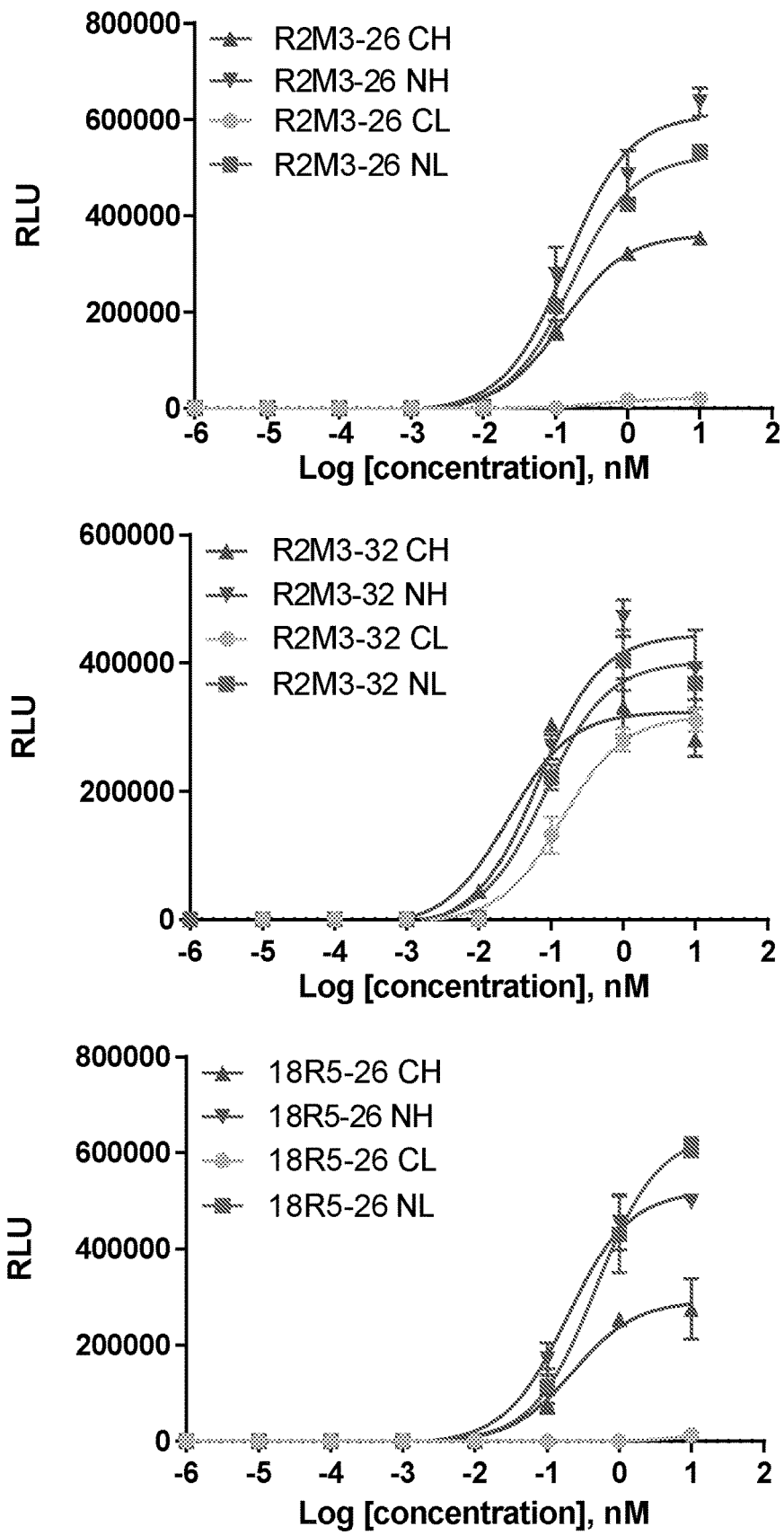
FIG. 9. SAR analysis of illustrative Wnt surrogate molecules in the IgG-Nab fusion format.

SAR analysis of the IgG-Nab fusions was performed by rotating the attachment location of the Nab to the different termini of the IgG HC or LC as depicted in FIG. 1A. CH indicates attaching the Nab to the C-terminus of heavy chain; NH indicates attaching the Nab to the N-terminus of heavy chain; CL indicates attaching the Nab to the C-terminus of light chain; NL indicates attaching the Nab to the N-terminus of light chain. Three pairs of IgG-Nab fusions SARs were shown, the pairs were between R2M3 and 26, between R2M3 and 32, and between 18R5 and 26. The assays were performed on Wnt responsive 293 reporter cells in the presence of Rspo and activated Wnt signaling to various levels (FIG. 9). These results demonstrate that the attachment location of the fusion and the geometry between the Fzd and LRP binding domains play roles in the ability of the Wnt surrogates to activate Wnt signaling.

Example 10

Characterization of R2M3-26 in the Fab Format

Figure 10:
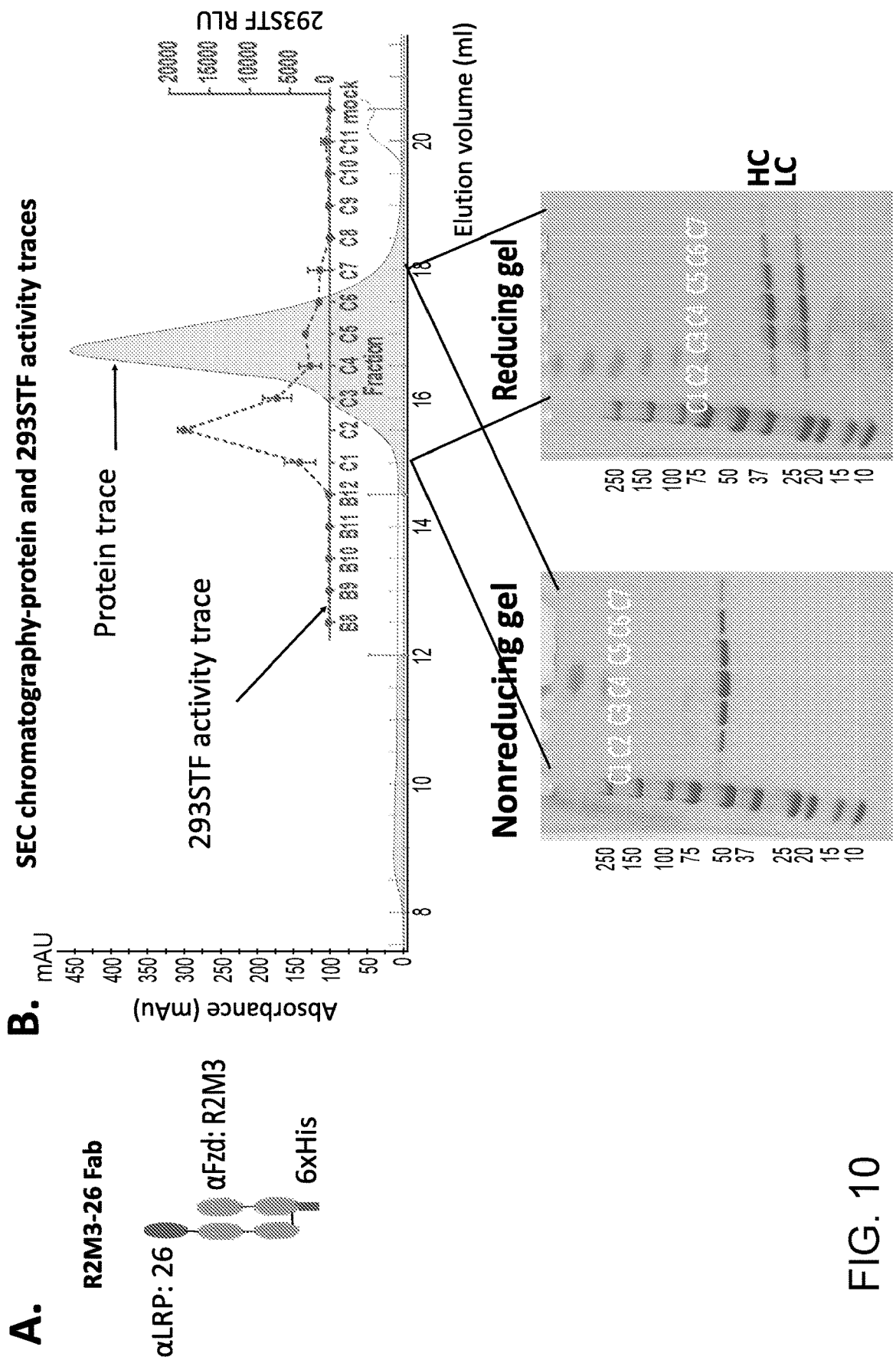
FIG. 10A-10B. Characterization of R2M3-26 in the Fab format in 293 Wnt dependent reporter assays.

The molecule R2M3-26 Fab consists of a Fzd binder (R2M3) and a LRP6 binder (26). The LRP6 binder 26 was fused to the N-terminus of R2M3 LC with a 5-amino acid linker as depicted in FIG. 10A. R2M3 was in the form of a Fab. The protein was purified by Ni-NTA affinity column followed by a size-exclusion-chromatography (SEC) step. The absorbance trace from the SEC and the SDS-PAGE gels of the SEC fractions are shown in FIG. 10B. The ability of R2M3-26 as a Fab format to activate canonical Wnt signaling was tested in a Wnt responding 293 reporter cells (293STF). The 293STF reporter activity traces across the SEC fractions are shown in FIG. 10B. Unlike when R2M3 was in the IgG format shown in FIG. 2, the peak of the reporter activity from the R2M3 in the Fab format did not correlate with the peak of the proteins. These results suggest that R2M3-26 fusion in the Fab format is ineffective in inducing canonical Wnt signaling as detected by a reporter assay.

Example 11

Characterization of R2M3-32 in the Fab Format

Figure 11:
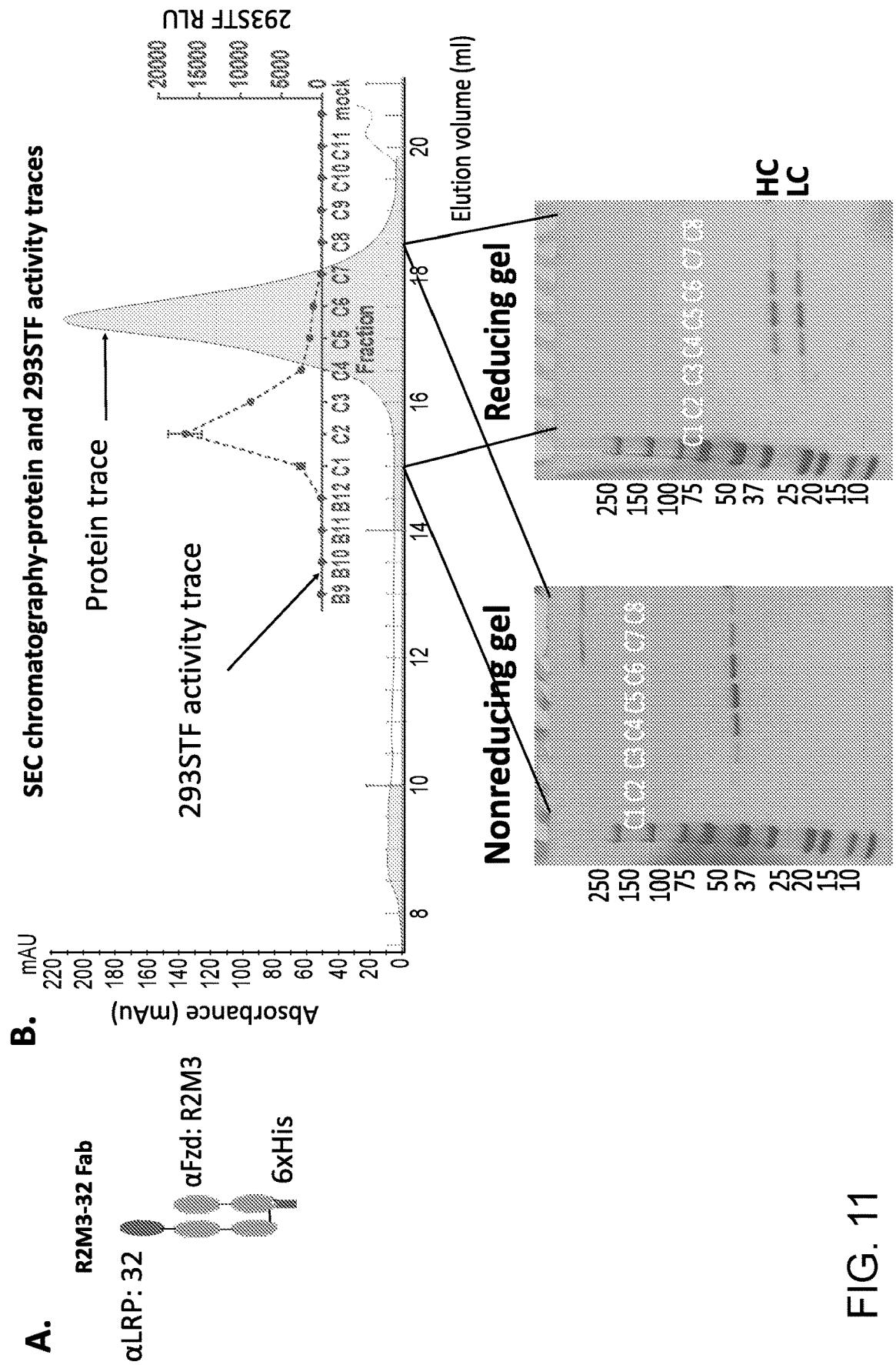
FIG. 11A-11B. Characterization of R2M3-32 in the Fab format in 293 Wnt dependent reporter assays.

The molecule R2M3-32 Fab consists of a Fzd binder (R2M3) and a LRP6 binder (32). The Lrp6 binder 32 was fused to the N-terminus of R2M3 LC with a 5-amino acid linker as depicted in FIG. 11A. R2M3 was in the form of a Fab. The protein was purified by Ni-NTA affinity column followed by a size-exclusion-chromatography (SEC) step. The absorbance trace from the SEC and the SDS-PAGE gels of the SEC fractions were shown in FIG. 11B. The ability of R2M3-32 as a Fab format to activate canonical Wnt signaling was tested in a Wnt responding 293 reporter cells (293STF). The 293STF reporter activity traces across the SEC fractions are shown in FIG. 11B. Unlike when R2M3 was in the IgG format shown in FIG. 3, the peak of the reporter activity from the R2M3 in the Fab format did not correlate with the peak of the proteins. These results suggest that R2M3-32 fusion in the Fab format is ineffective in inducing canonical Wnt signaling as detected by a reporter assay.

Example 12

Characterization of R2M3-26 in the Heterolg Format

Figure 12:
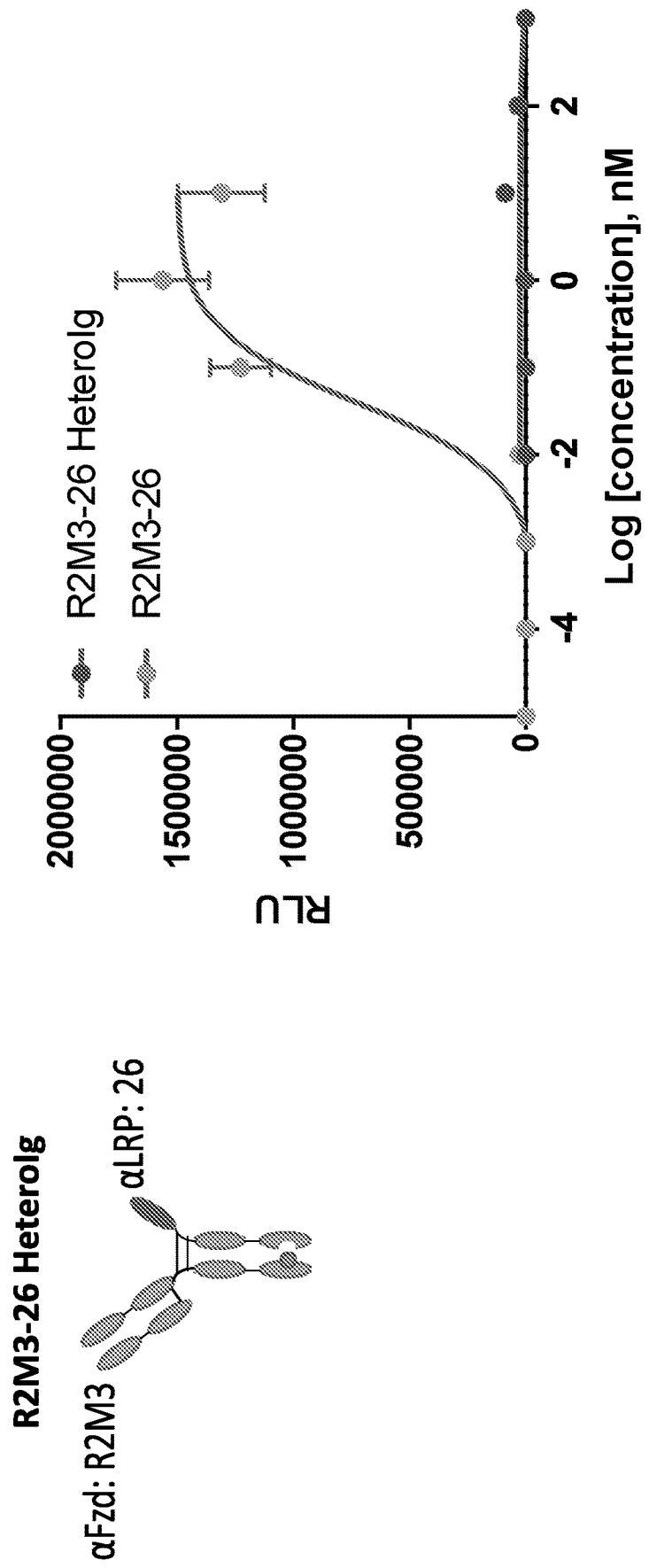
FIG. 12A-12B. Characterization of R2M3-26 in the Hetero-Ig format in 293 Wnt dependent reporter assays.

The molecule R2M3-26 Heterolg consists of a Fzd binder (R2M3) and a LRP6 binder (26) as depicted in FIG. 12A and described in FIG. 1A. The protein was purified by Protein A affinity column followed by a size-exclusion-chromatography (SEC) step. The peak fraction from the SEC column was tested in a dose response in the Wnt responsive 293STF reporter cells in the absence or presence of R-spondin (FIG. 12B). Compared to R2M3-26 in the IgG format (as described in FIG. 2), R2M3-26 Heterolg was ineffective in inducing canonical Wnt signaling as detected in the 293 reporter assay.

Example 13

Characterization of 26-17SB9 in the Nab-Nab Format

Figure 13:
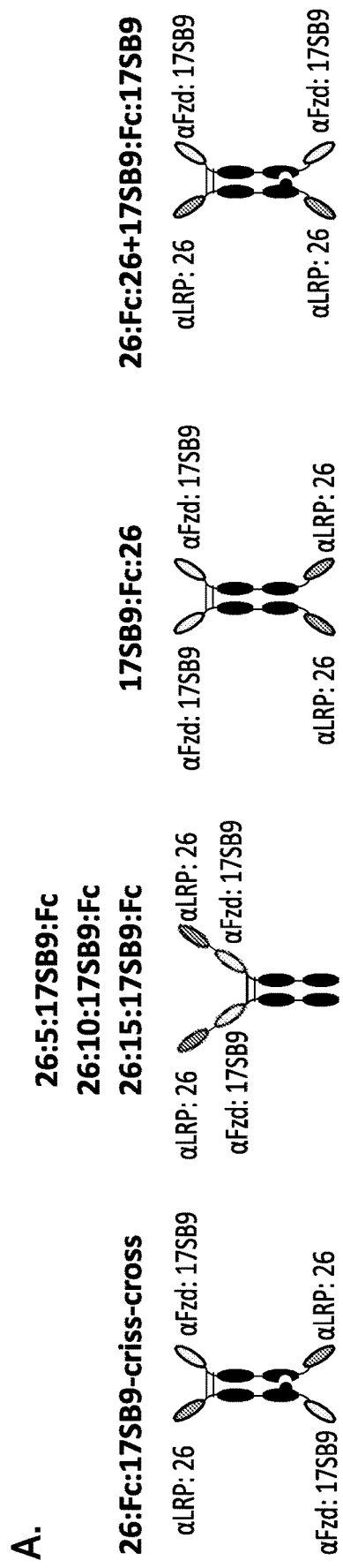
FIG. 13. Characterization of 26-17SB9 in the VHH/sdAb-VHH/sdAb format, in different tandem formats, and on different ends of the Fc fragment in 293 Wnt dependent reporter assays.

The molecule 26-17SB9 Nab-Fc-Nab consists of a LRP6 binder (26) and a Fzd binder (17SB9) as depicted in FIG. 13A and described in FIG. 1C. The protein was purified by Protein A affinity column followed by a size-exclusion-chromatography (SEC) step. The peak fraction from the SEC column was tested in a dose response in the Wnt responsive 293STF reporter cells in the absence or presence of R-spondin (FIG. 13B). 26-17SB9 in the Nab-Fc-Nab format induced canonical Wnt signaling as detected in the 293 reporter assay.

Additional combinations of 26 and 17SB9 were also constructed (FIG. 13C) and tested in 293 reporter assays. As shown in FIGS. 13D and 13E, these various combinations where 26 and 17SB9 were arranged in different tandem formats or on different ends of the Fc fragment all activated Wnt signaling to various levels in the presence of 20 nM R-spondin Example 14

Characterization of 18R5-LRP6 Binder Fusions in Tandem scFv Formats

Figure 14:
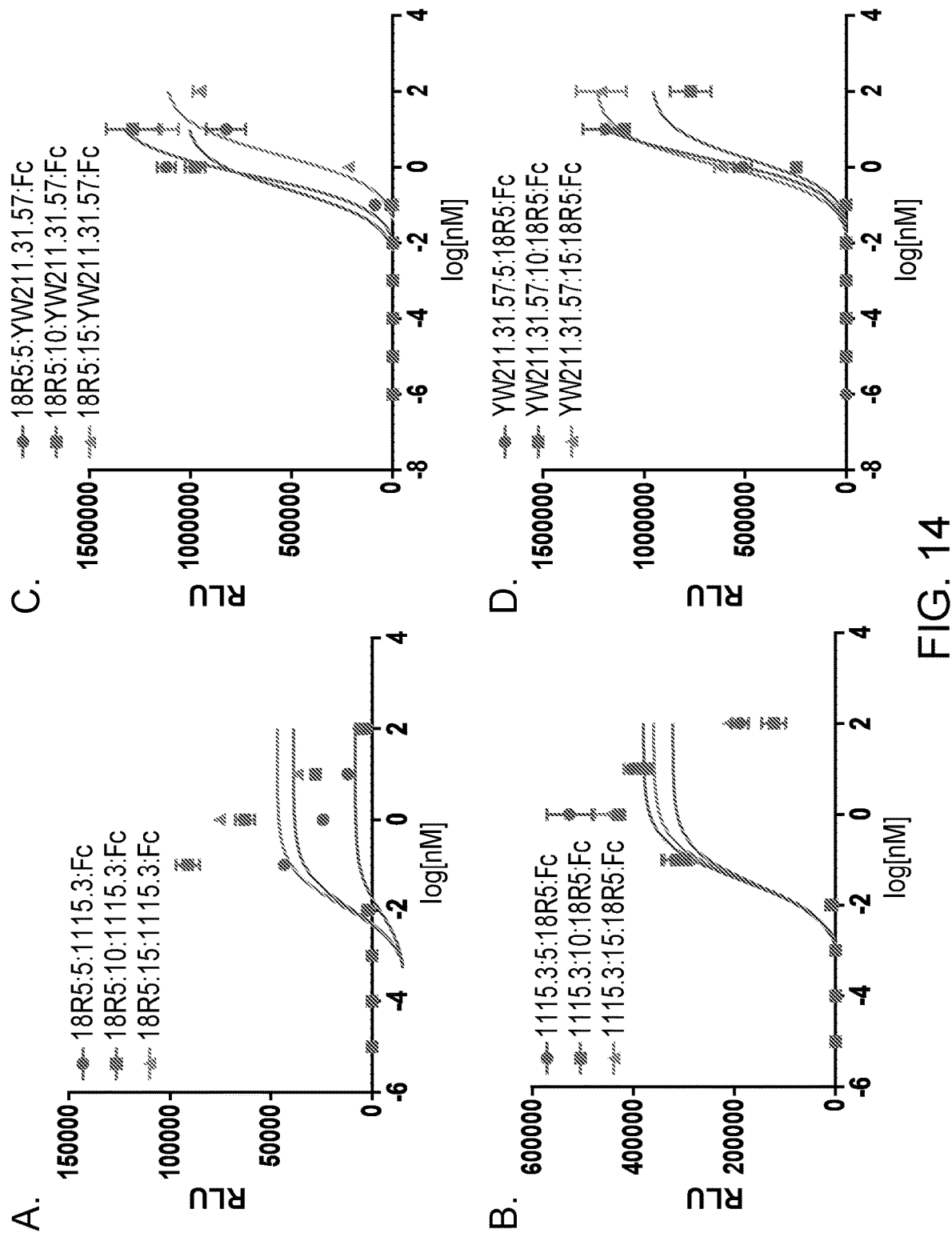
FIG. 14A-14H. Characterization of 18R5-LRP6 Binder Fusions in tandem scFv formats in 293 Wnt dependent reporter assays.

The Fzd binder 18R5, the LRP6E1E2 binder 1115.3 (as described in PCT Publication WO2009/064944), and the LRP6E3E4 binder YW211.31.57 (as described in PCT Publication WO2011/119661) were converted into scFv format. 1115.3_scFv or YW211.31.57_scFv is assembled to the N-terminus of 18R5_scFv with a 5, 10 or 15-amino acid linker and 18R5_scFv C-terminus is fused to a human Fc domain. In another set of examples, 1115.3_scFv or YW211.31.57_scFv is assembled to the C-terminus of 18R5 scFv with a 5, 10 or 15-amino acid linker and human Fc domain is fused to the C-terminus of LRP binders. These formats are depicted in FIG. 14G left panel. In another example, 18R5_scFv and LRP binder, 1115.3_scFv, or LRP binder, YW211.31.57_scFv were fused to the two ends of a human Fc domain (as depicted in FIG. 14G right panel). These proteins were purified by Protein A affinity column followed by a SEC step.

The fusion proteins were tested in a Wnt dependent reporter assays in 293 cells. 18R5_scFv-1115.3_scFv-Fc and 1115.3_scFv-18R5_scFv-Fc with 5, 10 or 15-mer linker were able to activate Wnt signaling (FIGS. 14A and 14B). 18R5_scFv-YW211.31.57_scFv-Fc and YW211.31.57_scFv-18R5_scFv-Fc with different linkers activated Wnt signaling (FIGS. 14C and 14D). In addition, 18R5_scFv and 1115.3_scFv or YW211.31.57 fused to the two ends of Fc also activated Wnt signaling (FIGS. 14E and F). While all of these scFv formats activated Wnt signaling, potency and overall maximal efficacy may differ depends on the binder combination, linker length, and relative orientation.

In another example, 1115.3_scFv or YW211.31.57_scFv is assembled to the N-terminus or C-terminus of 18R5_scFv with a 5, 10 or 15-amino acid linker without the further fusion of Fc, to create a bispecific but monovalent binding to each of Fzd or LRP. As shown in FIG. 14H, the 1115.3_scFv and 18R5_scFv fusions were in effective in activating Wnt signaling in the presence of 20 nM R-spondin in 293 reporter cells.

Example 15

Generation of Wnt Surrogate Molecules in the Fab-IgG Format

Wnt mimetic or surrogate molecules can be generated in various formats when both the FZD and LRP binders are Fabs. Various approaches, such as charge paring, "knobs-in-holes", crossover of the heavy and light chains of Fabs, can be employed to ensure proper heavy and light chain pairing. Two examples are given below.
1. Charge-pairing (cp) approach for Fab-on-IgG format: The heavy chain (VH-CH1) domain of an anti-LRP6 Fab, through a linker of 5, 10, or 15-mer amino acids, was fused in tandem with the N-terminus of the heavy chain (VH-CH1-CH2-CH3) of an anti-FZD binder. Both VH-CH1 domains of anti-LRP6 and anti-FZD contain three amino acid mutations (Q39D, Q105D, S183K in the anti-LRP6 Fab; Q39K, Q105K, S183E in anti-FZD Fab) each for proper paring with their own partner light chains, which also contain three complementary amino acid mutations (Q38K, A/S43K, S176E in anti-LRP6 light chain; Q38D, A/S43D, S176K in the anti-FZD light chain). The order of the anti-LRP6 and anti-FZD Fabs could be reversed, where the anti-FZD binder is a Fab and is fused to anti-LRP binder which is in IgG format (FIG. 15A).
2. HC-LC cross over approach for Fab-on-IgG format: The light chain (VL-CL) domains of anti-LRP6 binder was, through a linker of 5, 10, or 15-mer amino acids, fused in tandem with the N-terminus of the heavy chain (VH-CH1-CH2-CH3) of an anti-FZD binder. The second construct was VH-CH1 of the anti-LRP6 binder and the third construct was VL-CL of the anti-FZD binder. Similar to the example above, the order of the anti-LRP6 and the anti-FZD binders could be reversed, where anti-FZD binder Fab is fused to the N-terminus of the anti-LRP binder which is in IgG format (FIG. 15A).

Several different pairs of LRP and FZD binders were assembled in these formats and tested in a Wnt responding 293 reporter cell line (293STF). As an example, the anti LRP6E1E2 binder 421.1 (as described in PCT Publication WO2009/064944) was fused to the N-terminus of anti-FZD binder, R2M3, using the charge paring approach to generate, 421.1-R2M3 cp. 421.1-R2M3 cp dose-dependently activated Wnt signaling in the 293 reporter assay (FIG. 15B). An anti-FZD binder, 1RC07, was fused to the N-terminus of an anti-LRP binder, 10SA7, with 5, 10, or 15-mer linkers. All three fusion proteins activated Wnt signaling (FIG. 15C). The anti-FZD binder, 1RC07, was further fused with the anti-LRP binder, 10SG7, either with 1RC07 in the Fab format fused to the N-terminus of 10SG7 in IgG format, or in the reverse order where 10SG7 as Fab fused to the N-terminus of 1RC07 as IgG with either 5, 10, or 15-mer amino acid linkers. All fusion molecules activated Wnt signaling while some preference of orientation and linker length was observed (FIGS. 15D and 15E).

The HC-LC crossover Fab-IgG format was also tested. The anti-FZD binder 1RC07 LC was fused to the N-terminus of the anti-LRP6 binder 10SA7 HC to generate 1RC07-5: 10SA7 L→H. The LC of anti-LRP6E1E2 binder 1115.3 (as described in PCT Publication WO2009/064944) was fused to the N-terminus of the anti-FZD binder R2M3 HC with 5 or 10-mer linkers to generate 1115.3:5:R2M3 L→H or 1115.3:10:R2M3 L→H, respectively. These molecules also activated Wnt signaling (FIGS. 15F and 15G).

Example 16

Characterization of R2M3-26 in the F(ab')2 Format

Figure 16:
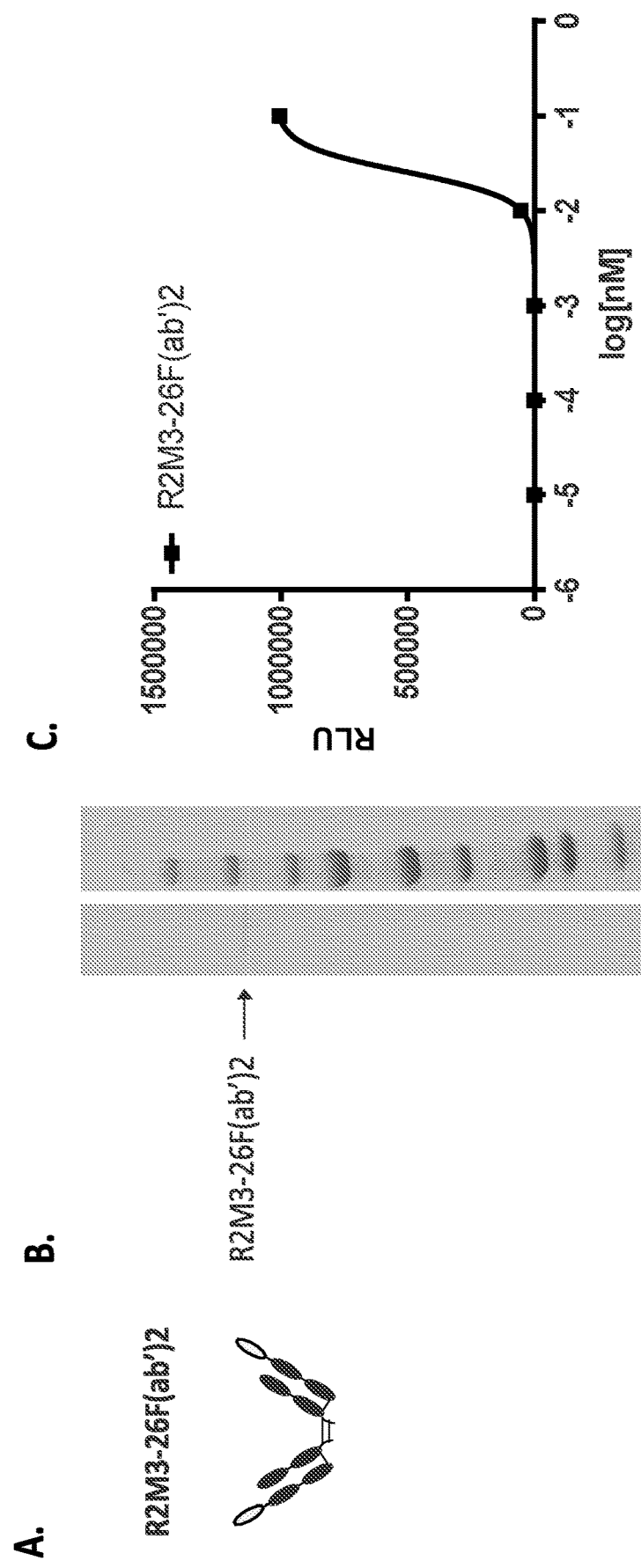
FIG. 16A-16C. Characterization of R2M3-26 in the F(ab')2 format in 293 Wnt dependent reporter assays.

R2M3-26 IgG1 was digested by IDES (Promega, WI) at 37° C. for 2 hours. Vast majority of the digested product was R2M3-26F(ab')2 (FIG. 16A), some partially digested product with one Fab still attached to Fc (designated as R2M3-26F(ab')2-Fc here) was also detected, and no uncleaved R2M3-26 was detected. The cleaved product was purified by anti-Lambda resin to remove the Fc fragment, then a SEC polishing was followed to separate the R2M3-26F(ab')2 from R2M3-26F(ab')2-Fc. The SDS-PAGE gel of the final purified protein is shown in FIG. 16B. The R2M3-26F(ab')2 activity was measured in STF assay in HEK293 cells. R2M3-26F(ab')2 was able to activate Wnt signaling (FIG. 16C).

Example 17

Characterization of Additional Wnt Surrogate Molecules

Figure 17:
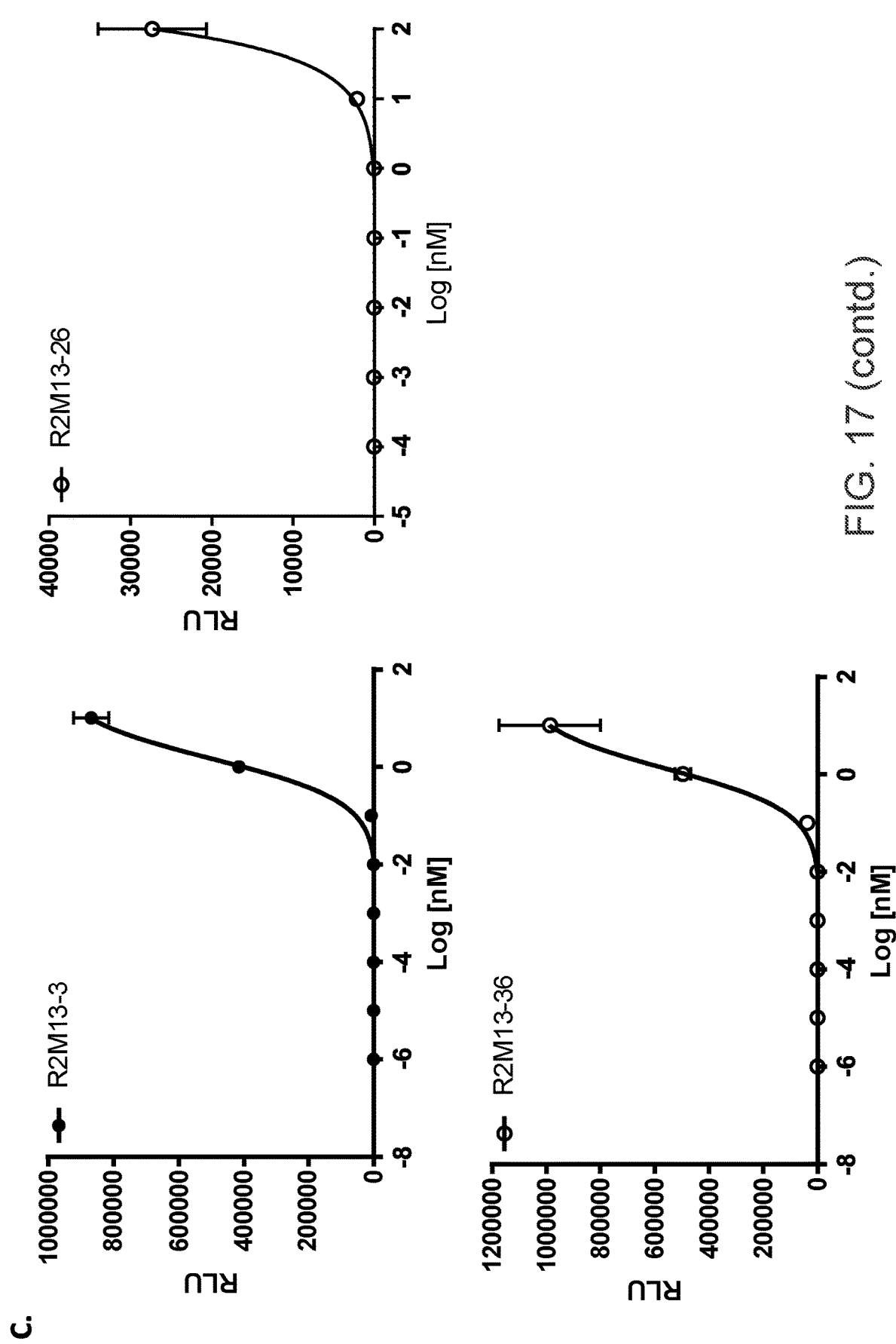
FIG. 17A-17H. Characterization of additional Wnt surrogate molecules in 293 Wnt dependent reporter assays FIG. 18A-18C. A. Schematic diagram of the 2Fv-Ig format. B-C. Characterization of the Wnt surrogate molecule, 10SG11-1RC07.

The FZD binders were fused to LRP binders. The LRP5 or 6 binders were Nabs (or VHHs) in this example and were fused to the N-terminus of FZD binders LC with a 5-amino acid linker (as represented in FIG. 17A). These proteins were purified by Protein A affinity column followed by a SEC step. The purified proteins were tested in Wnt dependent reporter assay in 293 cells (FIG. 17B, C, D, H), or 293 cells co-transfected with FZD4 expression construct (FIG. 17E, F), or 293 cells co-transfected with FZD9 expression construct (FIG. 17G) in the presence of 20 nM R-spondin. These molecules activated Wnt signaling with varying levels of potency and efficacy.

Example 18

Characterization of 10SG11-1RC07 in the 2Fv-Ig Format

Figure 18:
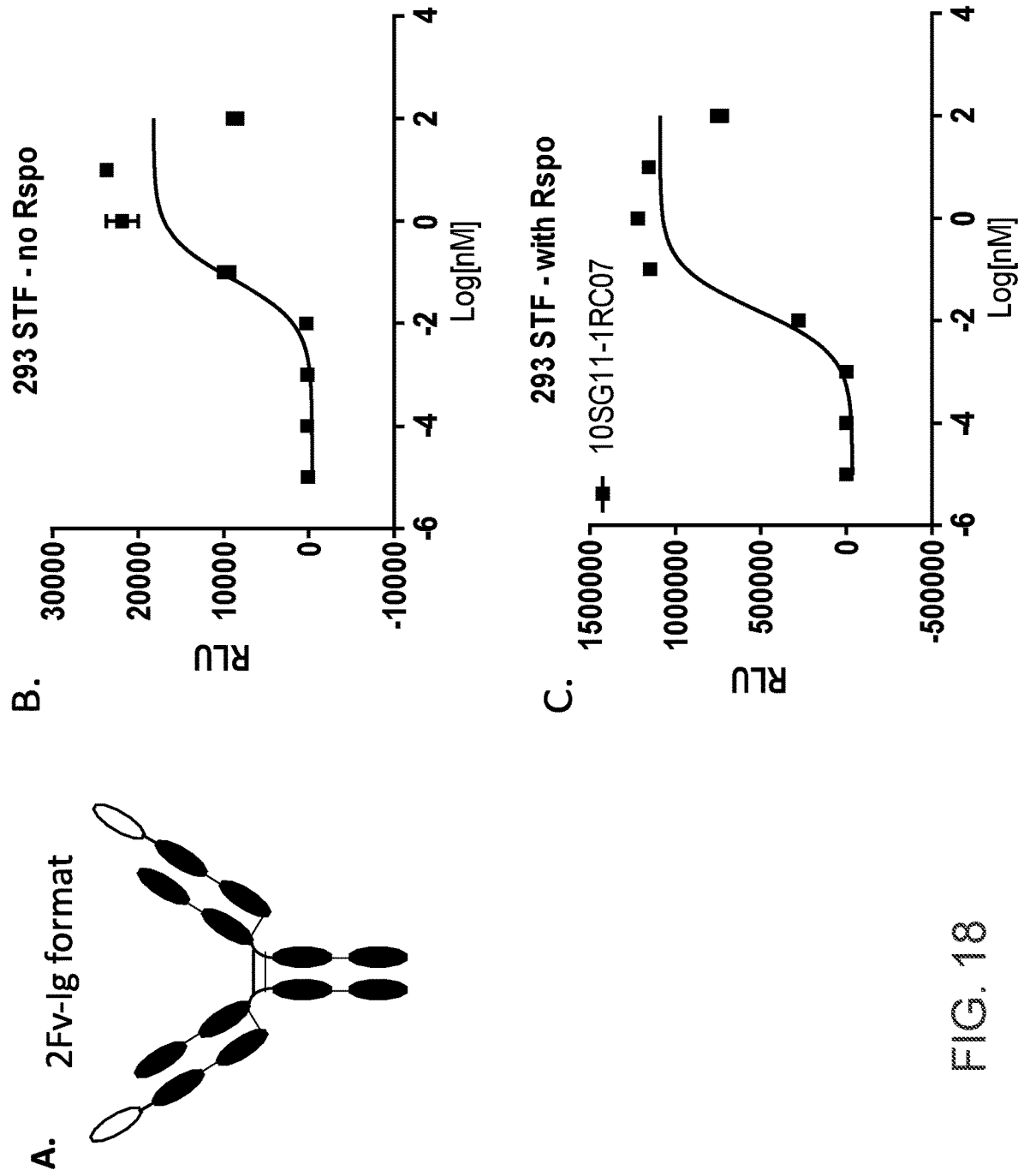

The molecule 10SG11-1RC07 consists of an N-terminal LRP binder (10SG11) and a Fzd binder (1RC07). The Fv of 10SG11 was fused to the N-terminus of 1RC07 with a 5-amino acid linker as depicted in FIG. 18A. 1RC07 was in the form of an IgG1 with the Fc mutations L234A/L235A/P329G. The protein was purified by a Protein A affinity column followed by an SEC step. The fusion protein was tested in Wnt dependent reporter assays in 293 cell lines and demonstrated the ability to activate Wnt signaling (FIG. 18B-C)

Example 19

In Vivo PK/PD Characterization of R2M3-26

Six-week old C57Bl/6J male mice were obtained from Jackson Laboratories (Bar Harbor, Me., USA) and were housed 3 per cage. All animal experimentation was in accordance with the criteria of the "Guide for the Care and Use of Laboratory Animals" prepared by the National Academy of Sciences. Protocols for animal experimentation were approved by the Surrozen Institutional Animal Care and Use Committee. Mice were acclimatized a minimum of two days prior to initiating experiments. Mice had unlimited access to purified, laboratory-grade acidified water and were fed ad libitum (2018 Teklad global 18% protein rodent diet) Mice were kept 12/12-hour light/dark cycle in a 30% to 70% humidity environment and room temperature ranging from 20° C. to 26° C.

For the pharmacokinetic (PK) study (FIG. 20A), n=3 per group was used. Mice were dosed with R2M3-26 (with effectorless Fc mutations) at 1 mg/kg (10 ml/kg in saline) either using intravenous (IV) or intraperitoneal (i.p.) injections. Mice were anesthetized with isoflurane and blood was removed from the retro-orbital plexus, tail vein or heart at 10 minutes, 30 minutes, 1, 4, 24, 72 or 144 hours after injection. Blood was allowed to coagulate at room temperature, followed by centrifugation for 7 minutes at 8,000 g. The serum was removed and stored at −20° C. until the measurement of serum R2M3-26 concentrations by ELISA with Anti Human IgG Fc Fragment (Jackson Immuno Research Labs NC9747692).

For the pharmacodynamic (PD) study (FIG. 20B), n=6 per group was used. Mice were injected i.p. with R2M3-26 at the indicated doses (10 ml/kg in saline). Control mice received saline only. Eight hours later, mice were anesthetized with isoflurane and the blood was collected by cardiac puncture. Blood was allowed to coagulate at room temperature, followed by centrifugation for 7 minutes at 10,000 g. The serum was removed and stored at −20° C. until the measurement of serum R2M3-26 concentrations by ELISA. A portion of the left liver lobe was snap-frozen in liquid nitrogen and stored at −80° C. for RNA analysis. RNA was extracted from liver samples using the MagMAX™ mirVana™ Total RNA Isolation Kit (ThermoFisher, A27828). cDNA was produced using the high-Capacity cDNA Reverse Transcription Kit (ThermoFisher, 43-688-14). Axin2 mRNA expression was measured by using TaqMan® Fast Advanced Master Mix (ThermoFisher, 4444963) and the Mm00443610_m1 Axin2 Probe (Thermofisher, 4331182).

These studies showed that R2M3-26 was stable, highly bioavailable and active in vivo, as shown by the induction of Axin2 mRNA expression.

Example 20

In Vivo Bone Model and Characterization of AAV-Delivered Wnt Surrogates

Figure 5:
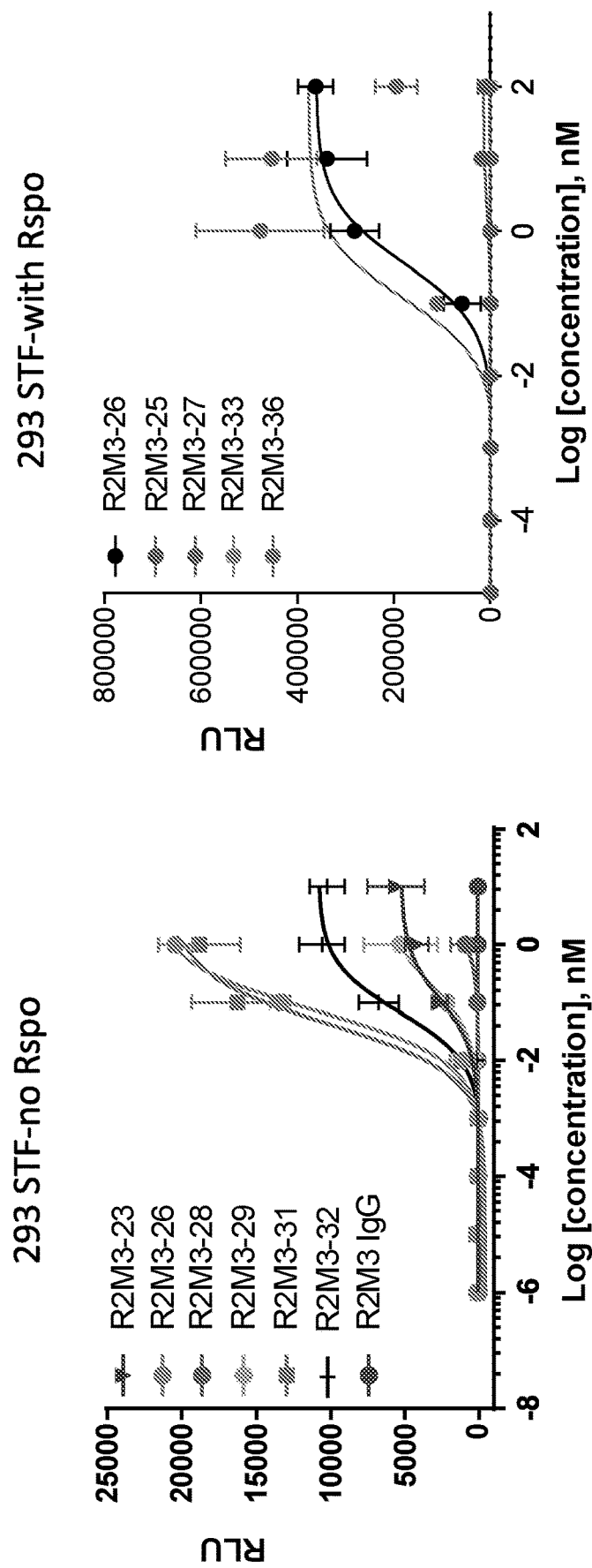
FIG. 5. Characterization of illustrative R2M3-Lrp6 binder fusions in 293, Huh7, A375, and BNL.CL2 Wnt dependent reporter assays.
Figure 21B:
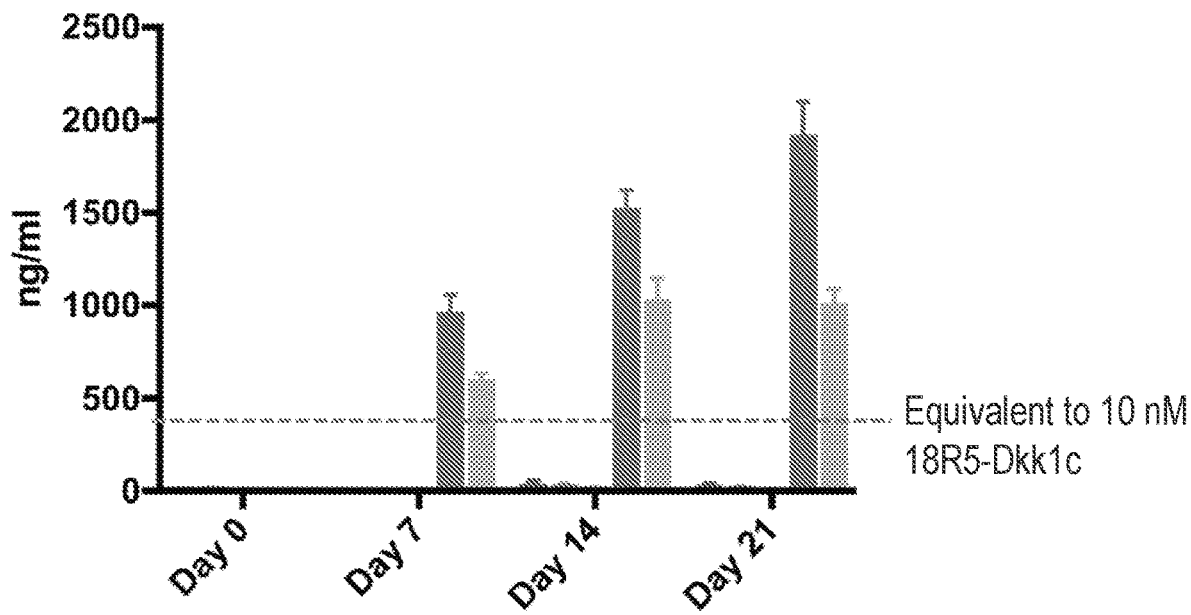
Figure 21C:
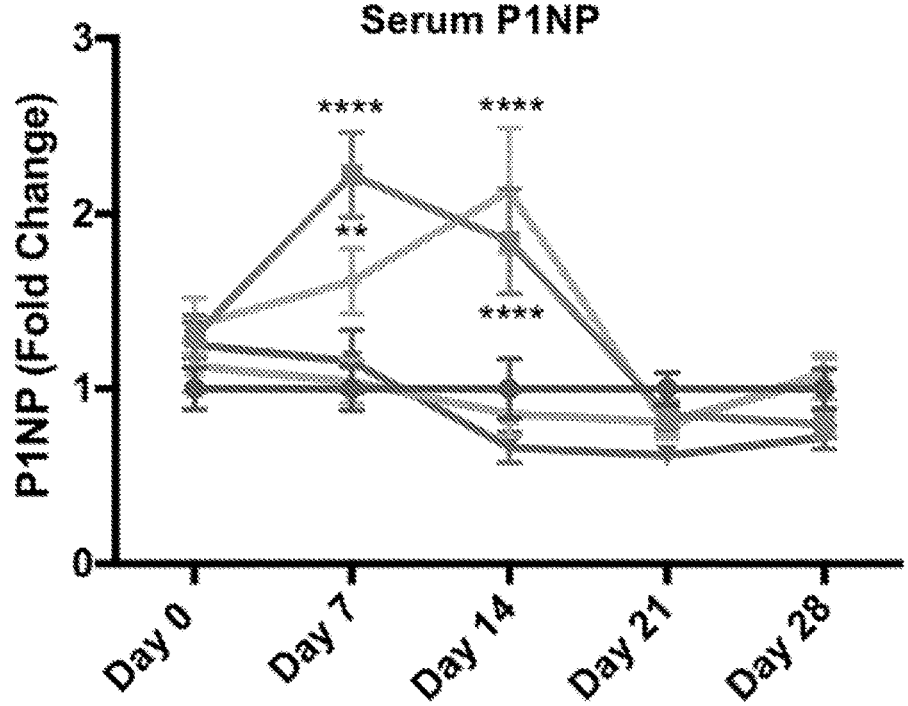
Figure 21D:
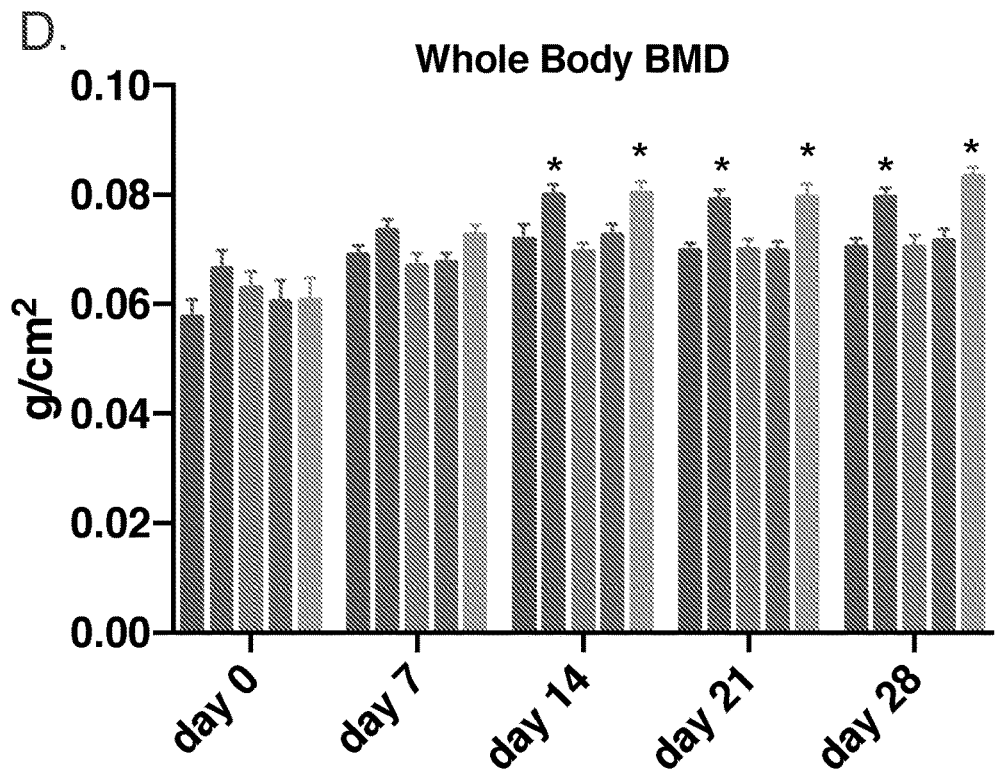
Figure 21E:
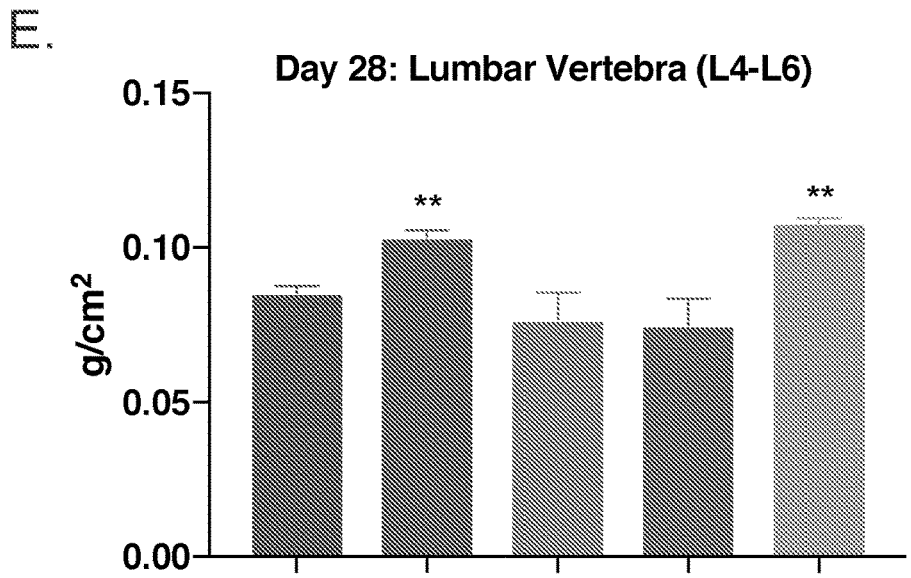
Figure 22A:
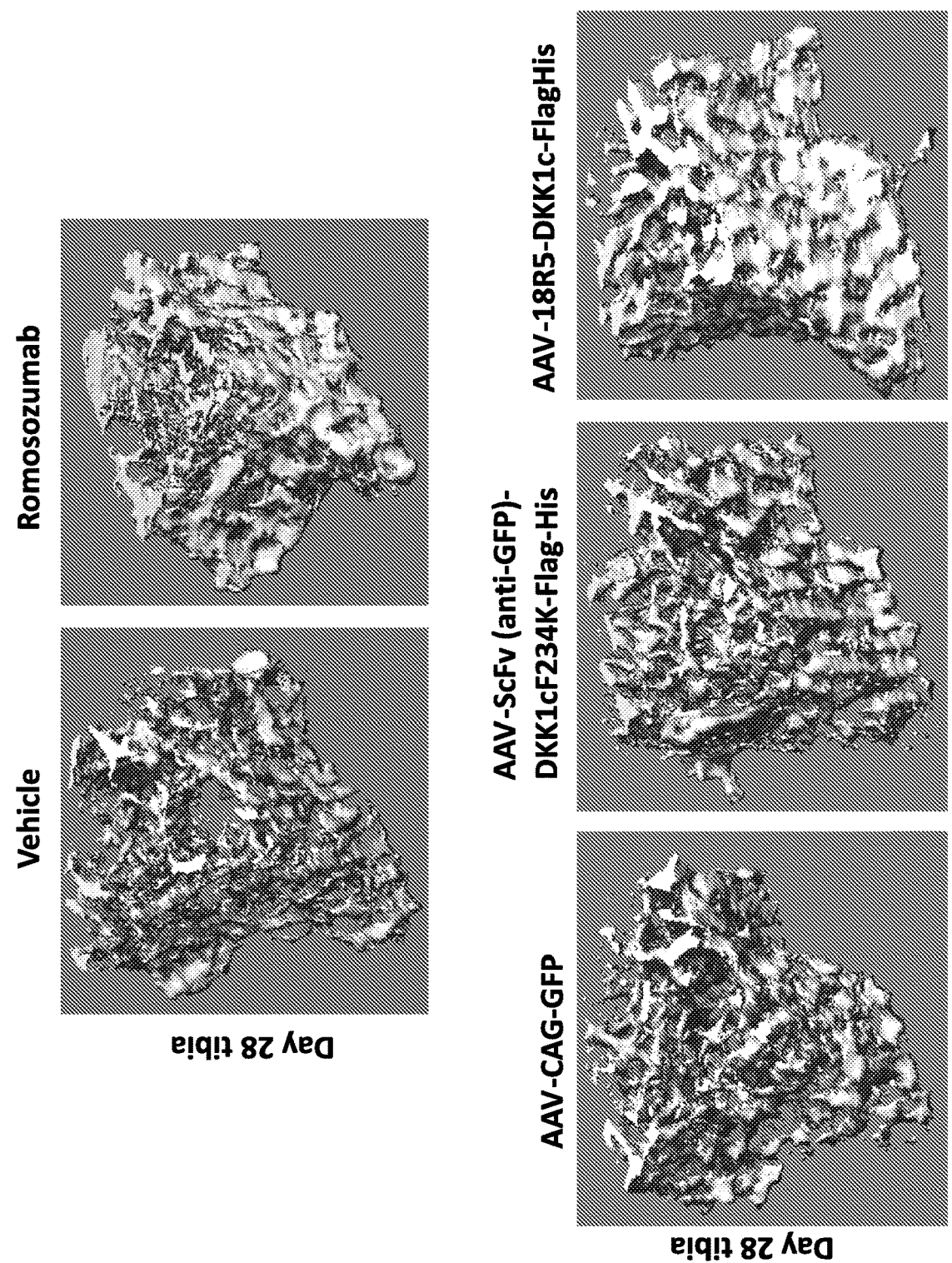
FIGS. 22A-22D. Images and graphs showing that systemic expression of 18R5-DKK1c for 14 days or 28 days results in increased bone volume. For each time point, the bars from left to right are as follows: vehicle, romosozumab, AAV CAG-GFP, AAV ScFv (anti-GFP)-DKK1cF234K-Flag-His, and AAV 18R5-DKK1c-FLagHis. *P value<0.05;  P value<0.0001, **P value<0.0001.
Figure 22B:
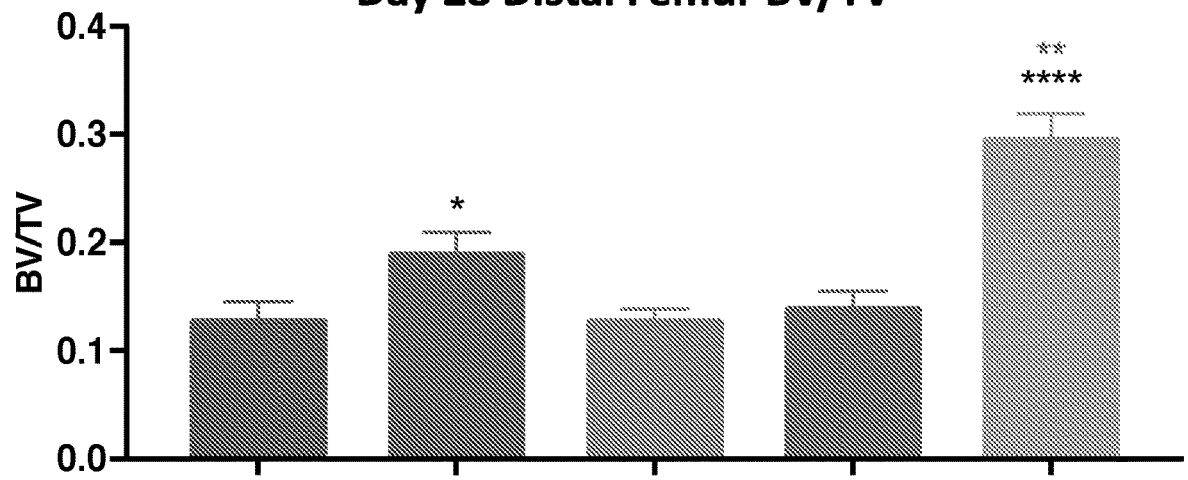
Figure 22C:
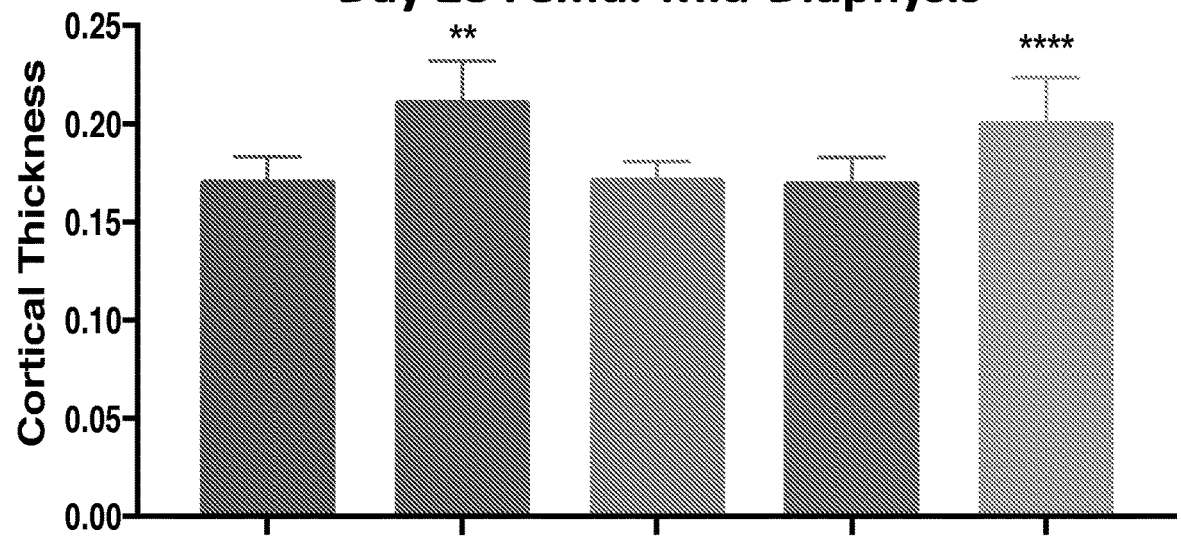
Figure 22D:
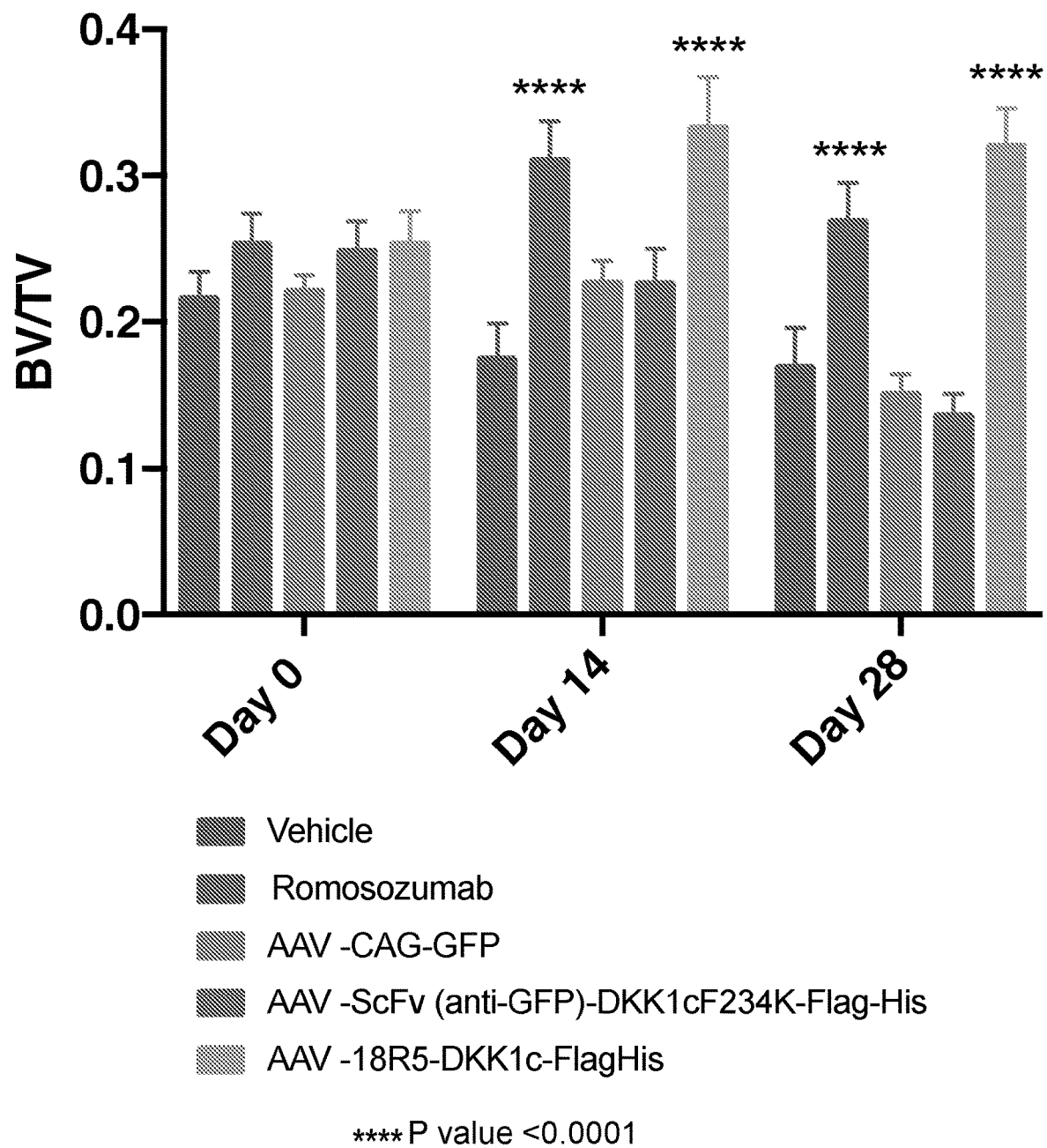

In vivo experiments were conducted by infecting mice with an AAV vector that expressed Flag- and His-tagged 18R5-DKK1c protein (AAV-18R5-DKK1c-FlagHis). 18R5-DKK1c is a fusion protein containing the frizzled binding antibody, 18R5, in scFv format, fused to DKK1c, as described in PCT Publication WO2016/040895, e.g., FIG. 5. Control mice were treated with vehicle only, romosozumab, an AAV vector that expressed green fluorescent protein (GFP) (AAV-CAG-GFP), or an AAV vector that expressed a fusion protein comprising an anti-GFP scFv fused to a mutant DKK1c (AAV-ScFv (anti-GFP)-DKK1cF234K-Flag-His). 28 days after infection, animals were sacrificed and bone mineral density, bone volume and other characteristics were measured. As shown in FIGS. 21A-21E, systemic expression of 18R5-DKK1c resulted in significantly increased bone mineral density as early as 14 days of 18R5-DKK1c systemic expression, as determined by dual X-ray absorptiometry (DEXA) scan. Systemic expression of 18R5-DKK1c increased bone mineral density (BMD) as measured by DEXA scan (FIG. 21A) and increased levels of the serum P1NP bone formation marker in naïve mice (FIG. 21C). Serum levels of AAV-ScFv (anti-GFP)-DKK1cF234K and 18R5-DKK1c were detected in the serum and found to be well above the in vitro determined EC50 (FIG. 21B). AAV-CAG-GFP and AAV-ScFv (anti-GFP)-DKK1cF234K were negative controls. Romosozumab was a positive control, and vehicle only was a negative control. 18R5-DKK1c also increase bone density in lumbar vertebra and whole body, as shown in FIGS. 20D and 20E, wherein * indicates P value<0.05 and  indicates P value<0.0001. 18R5-DKK1c expression through AAV also increased bone volume in tibia and femur and cortical thickness in femur mid-diaphysis at 28 days after treatment in naïve mice as measured by micro CT, as shown in FIGS. 22A-22D, wherein ** indicates P value<0.0001.

Figure 23A:
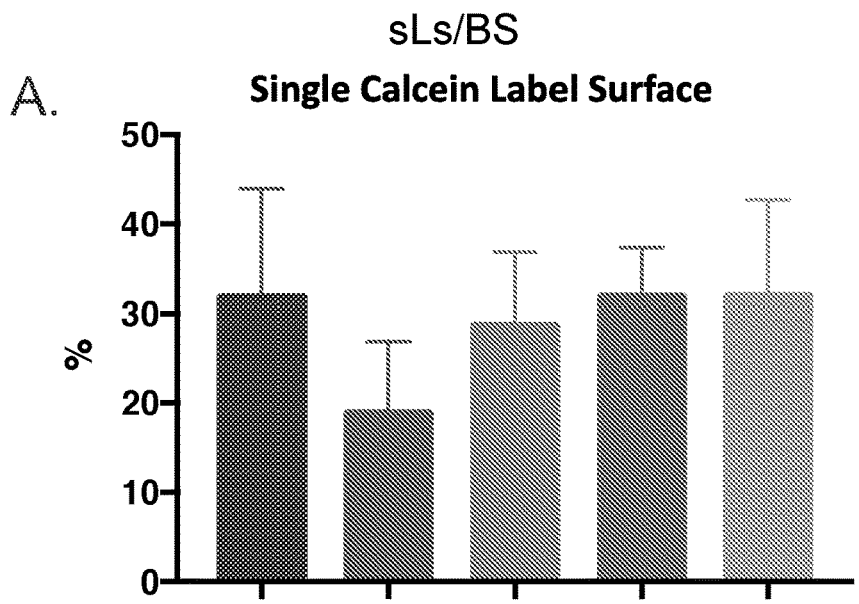
FIGS. 23A-23B. Graphs showing the dynamic parameters of bone formation based on fluorochrome labelling. For each time point, the bars from left to right are as follows: vehicle, romosozumab, AAV CAG-GFP, AAV ScFv (anti-GFP)-DKK1cF234K-Flag-His, and AAV 18R5-DKK1c-FlagHis.
Figure 23B:
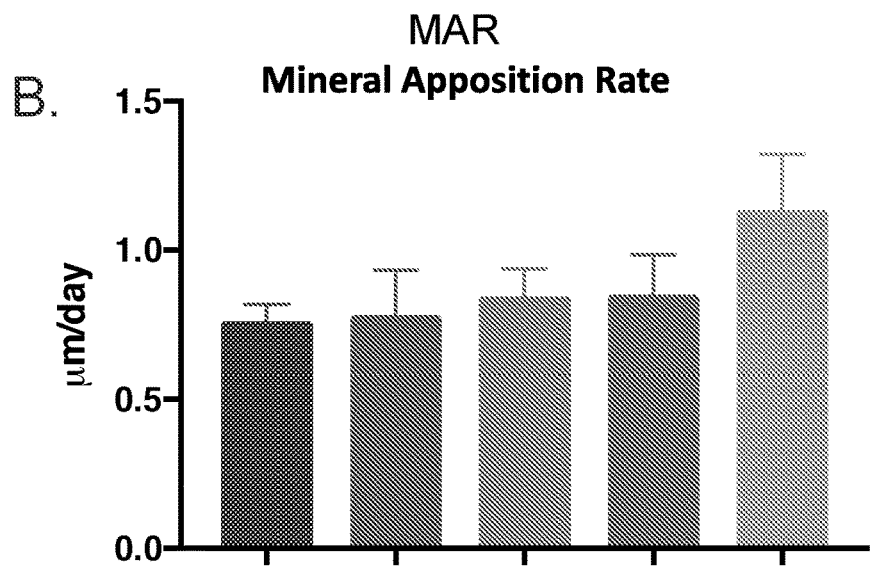

Systemic expression of 18R5-DKK1c resulted in significantly increased mineral apposition rate from baseline to single label in last 8 days, as shown in FIGS. 23A and 23B.

Systemic expression of 18R5-DKK1c also resulted in increased osteoblast numbers and decreased osteoclast numbers, as shown in FIGS. 24A-24D.

Figure 25A:
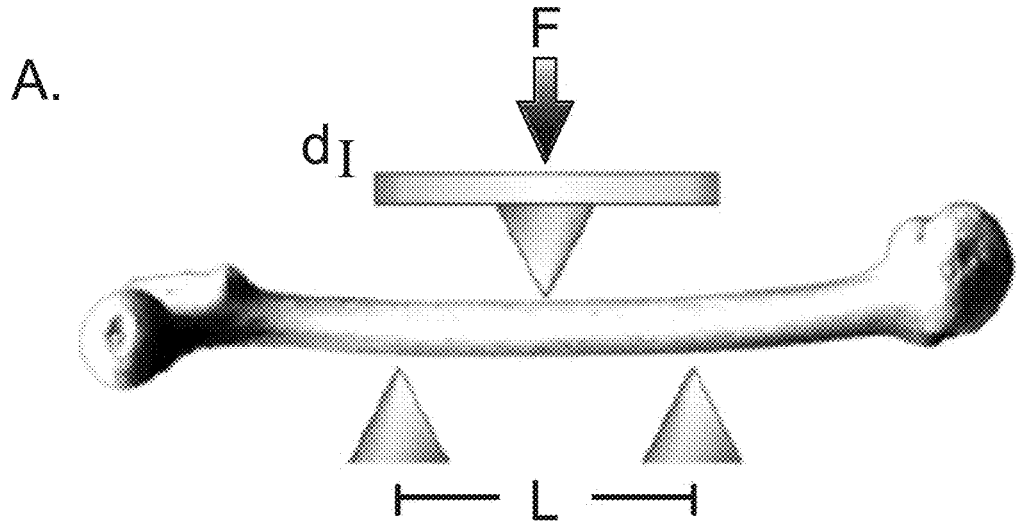
FIGS. 25A-25C. Diagram of assay for bone stiffness and fracture and graphs showing ultimate load to failure and stiffness in mice treated as indicated.
Figure 25B:
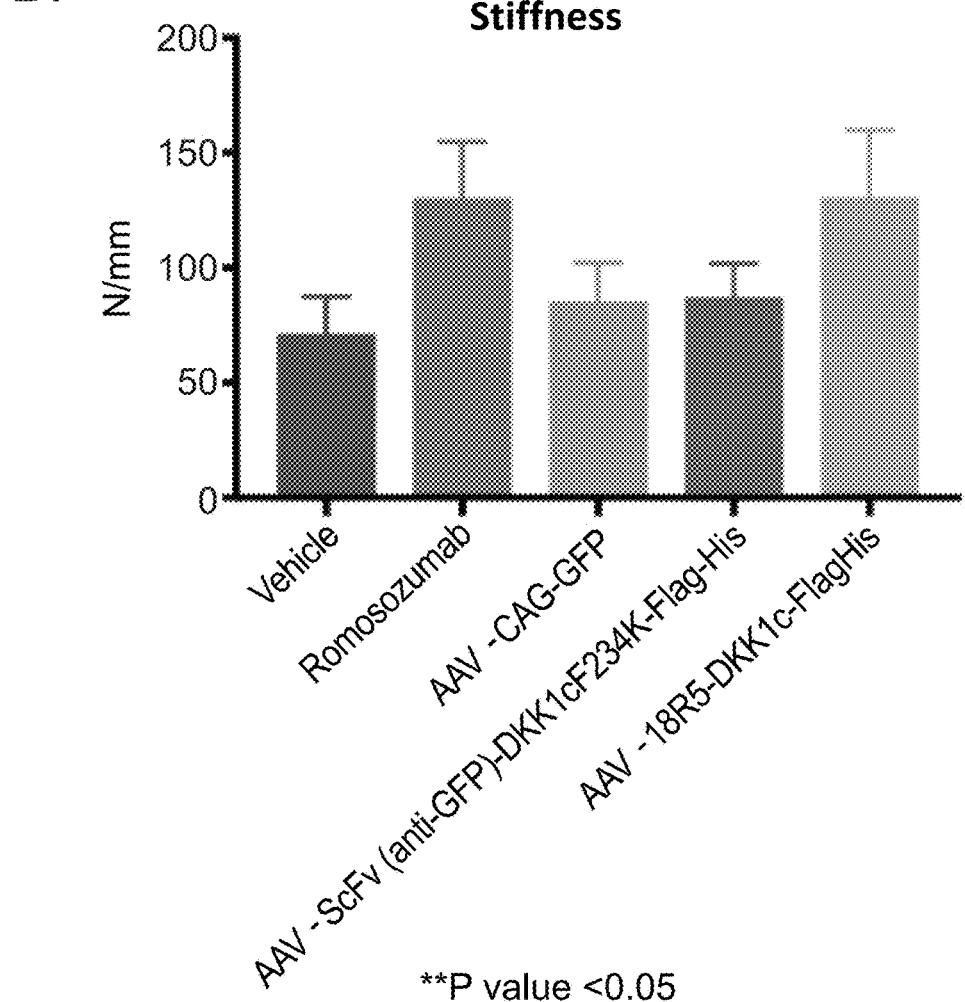
Figure 25C:
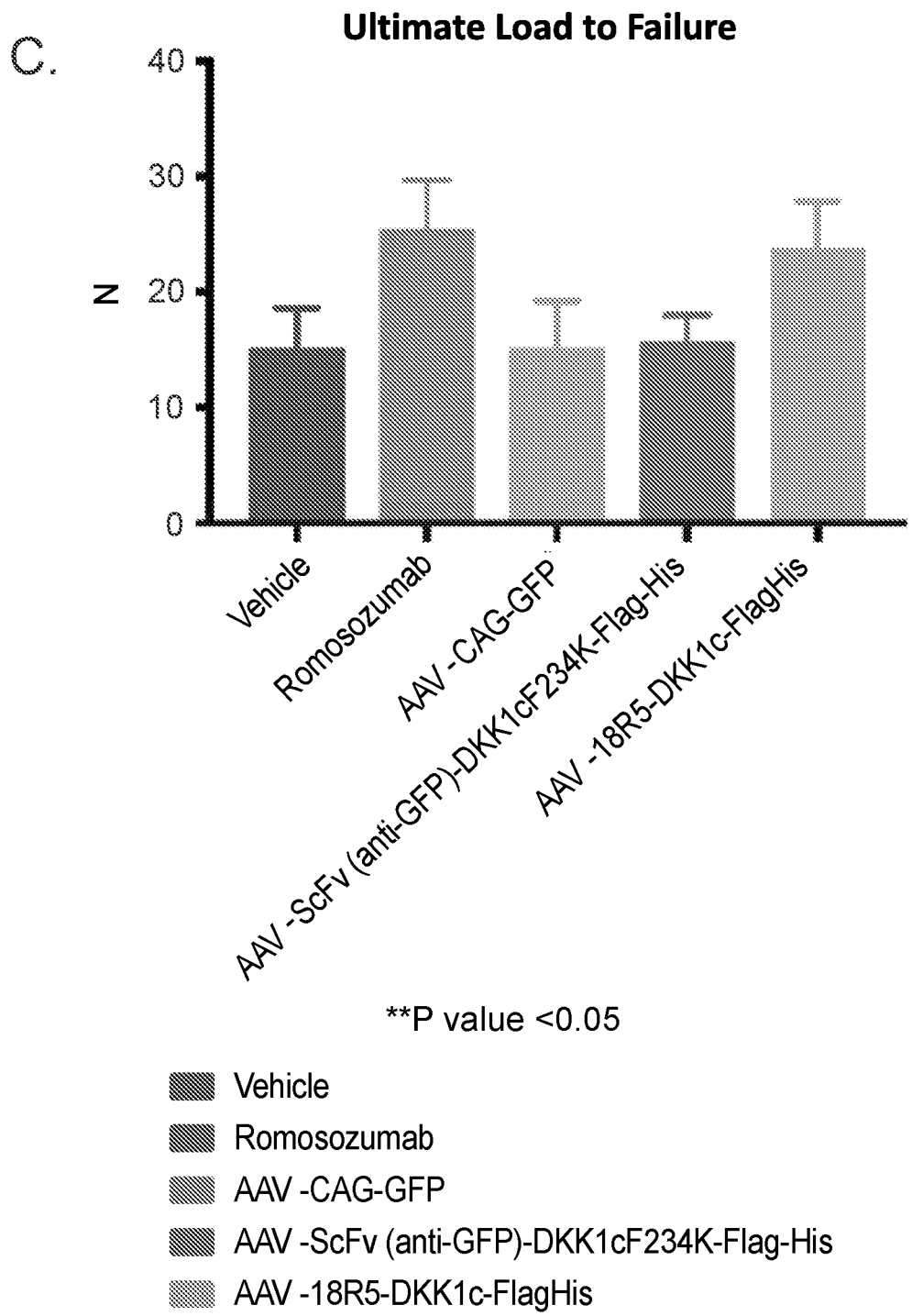
Figure 26A:
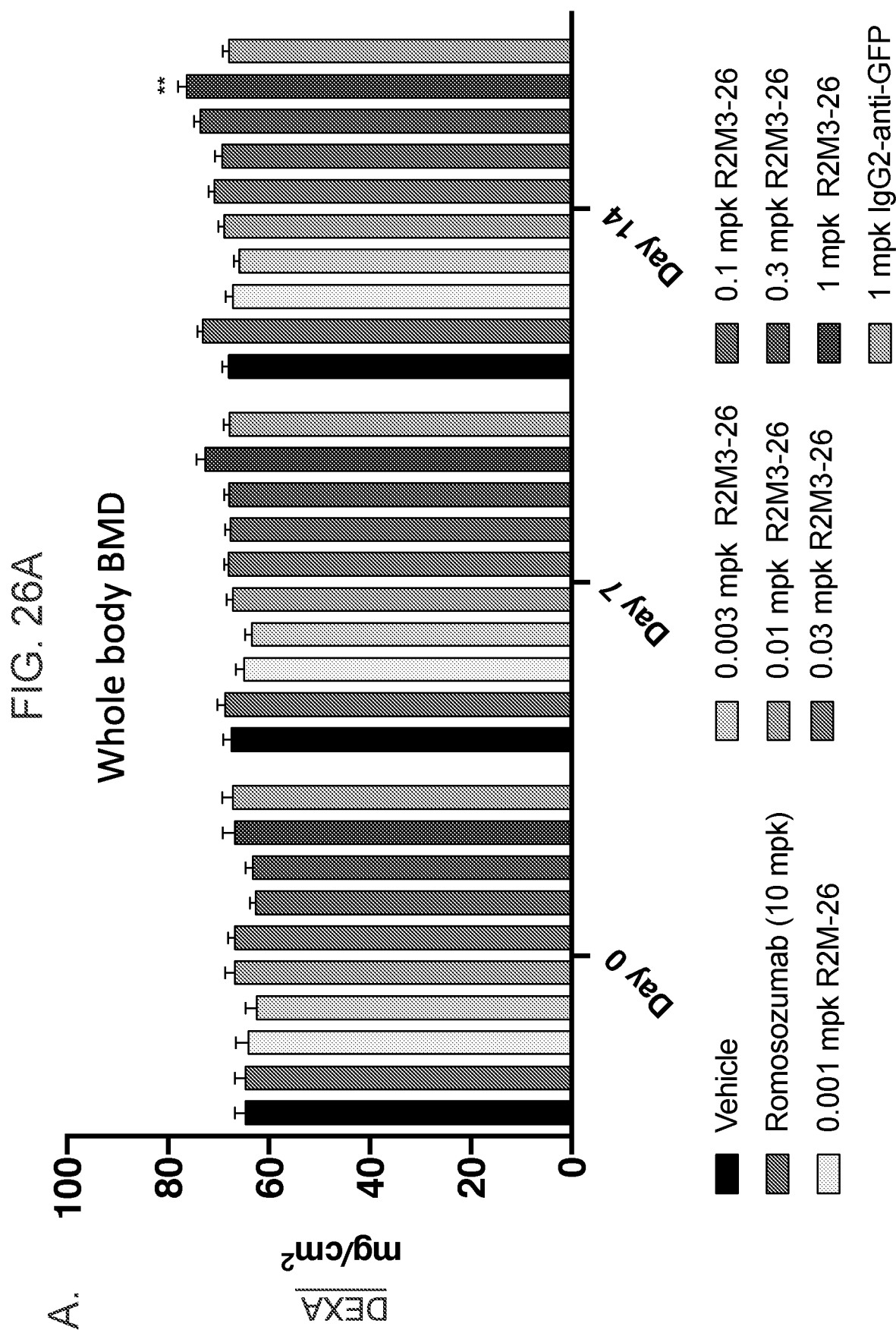
Figure 26B:
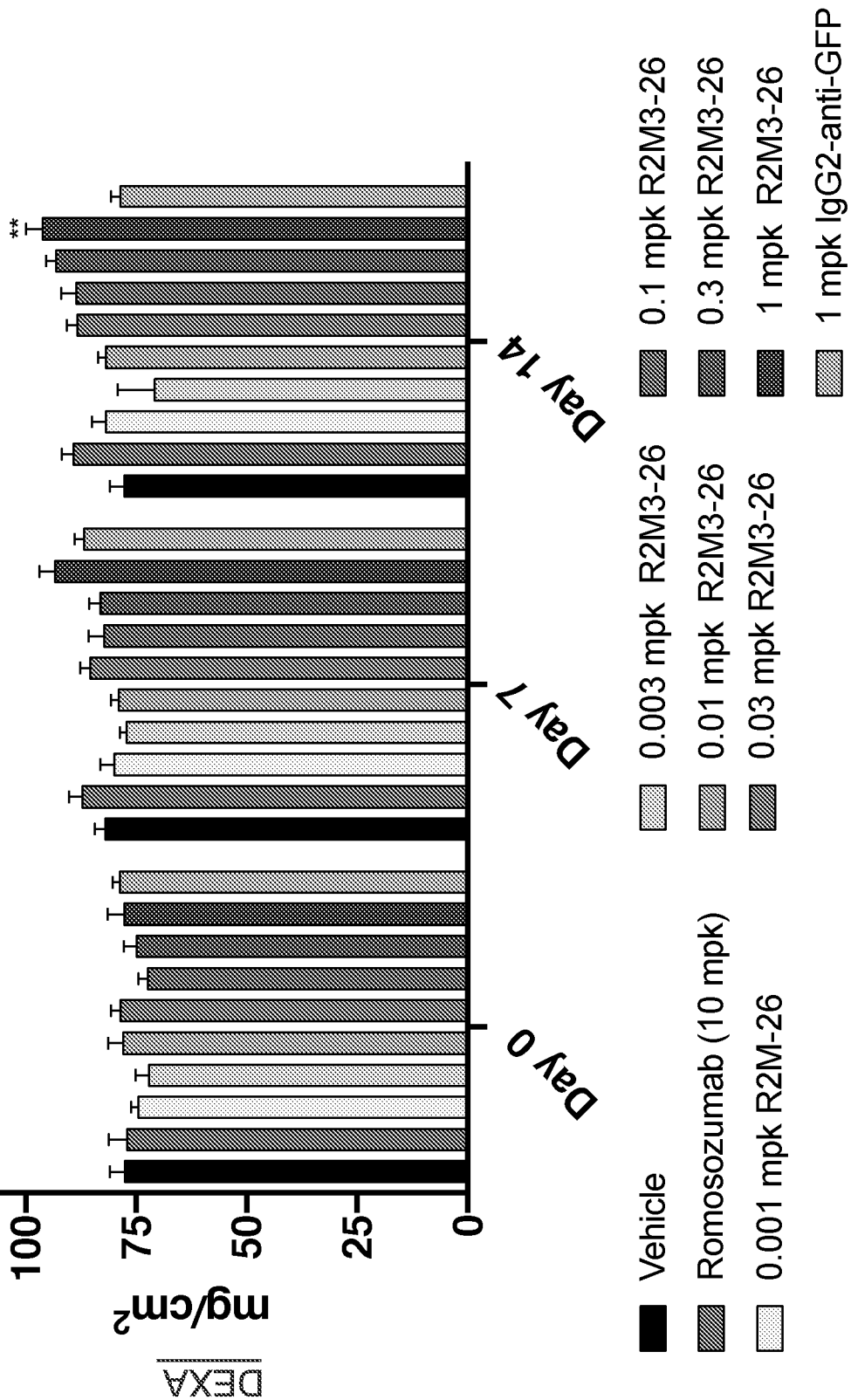

18R5-DKK1c treatment increased bone stiffness and ultimate load to fracture in biomechanical testing, suggesting improved resistance to fracture, as shown in FIGS. 25A-25C.

These studies demonstrated that systemic expression of 18R5-DKK1c using AAV increased bone mineral density (BMD) as measured by DEXA, and also showed that 18R5-DKK1c increased bone volume as measured by micro CT as early as 14 days of treatment. 18R5-DKK1c also increased cortical thickness 28 days after treatment. Systemic expression of 18R5-DKK1c resulted in significantly increased mineral apposition rate, increased osteoblast numbers, and decreased osteoclast numbers. It also increased bone stiffness and ultimate load to fracture, suggesting improved resistance to fracture.

Example 21

In Vivo Bone Model and Characterization of Wnt Surrogates Produced as Recombinant Proteins In vivo experiments were conducted by treating mice with recombinantly produced R2M3-26 protein at various dosages via i.p. injection. Control mice were treated with vehicle only (negative control), romosozumab (positive control), anti-Beta-Galactosidase (negative control), or IgG2-anti-GFP (negative control). Bone mineral density (BMD) measured by DEXA and bone volume measured by micro CT were monitored longitudinally at indicated time points. Four weeks after treatment, animals were sacrificed and bone characteristics were measured. For single injection of R2M3-26, the experimental data was monitored and is shown for two weeks after treatment.

Treatment with recombinant R2M3-26 induced rapid and sustained increase of bone mineral density (BMD) and bone volume in naive mice, as shown in FIGS. 26A-26D. Both bone volume and BMD increased rapidly, suggesting resistance to fracture.

Figure 27A:
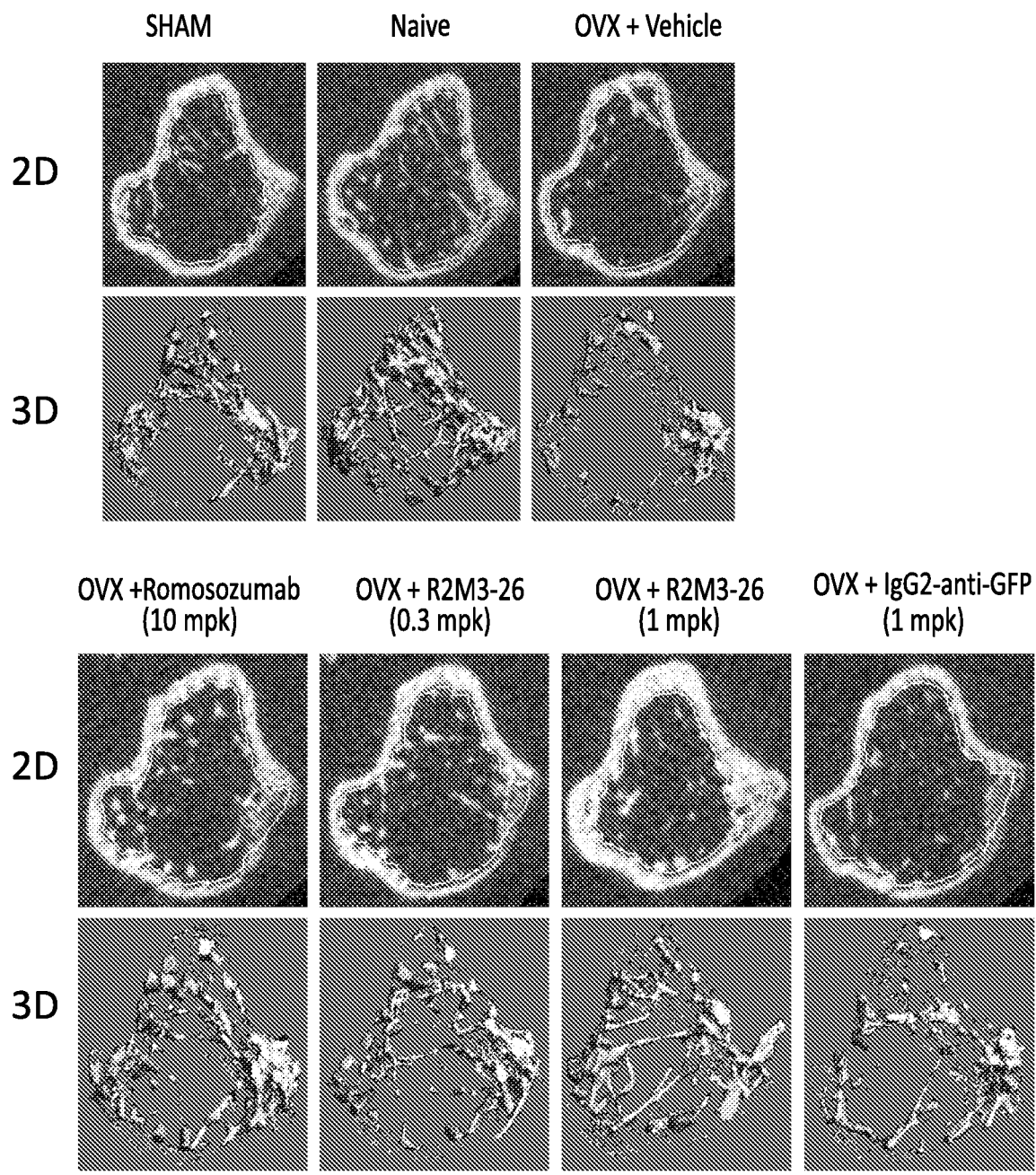
FIGS. 27A-27C. Images and graphs showing that R2M3-26 treatment rapidly reverses the bone loss associated with ovariectomy-induced osteoporosis. For each time point, the bars from left to right correspond to the treatments indicated from top to bottom.
Figure 27B:
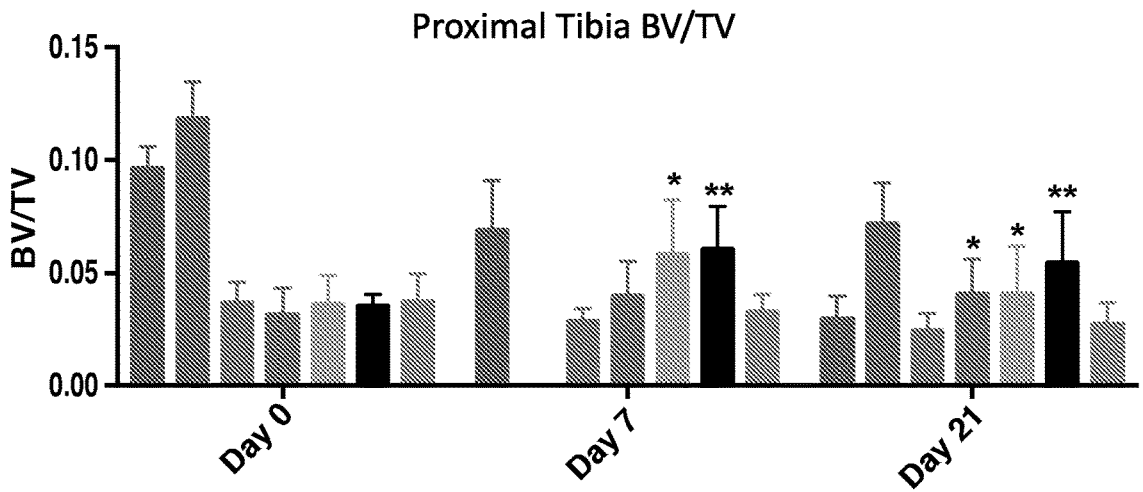
Figure 27C:
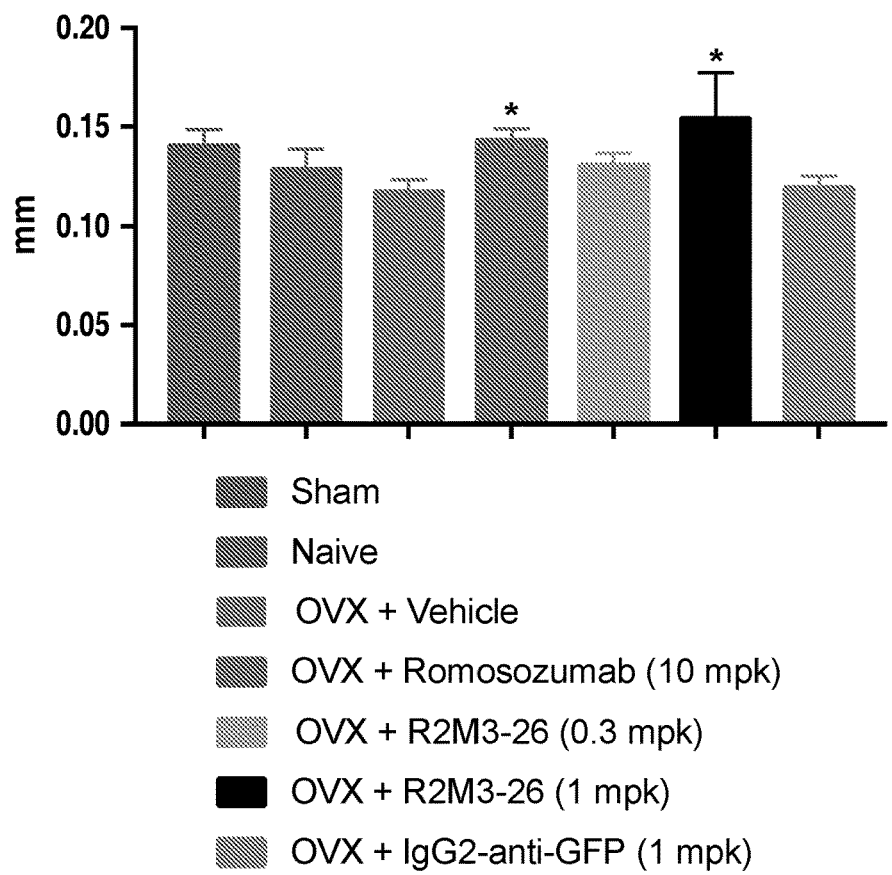

The ovariectomy induced osteoporosis model is a well-established high-hurdle model for determining the ability of an anabolic therapy to overcome the bone loss associated with hormone ablation (Zhou, S. et. al., Journal of Cellular Biochemistry, PMID: 11455579). Treatment with recombinant R2M3-26 treatment reversed bone loss in an ovariectomy-induced osteoporosis mouse model, as shown in FIGS. 27A-27C. Increased cortical thickness was observed in the trabecular regions, suggesting increased compressive strength. R2M3-26 treatment increased femur mid-diaphysis cortical bone thickness after 42 days as measured by micro CT, as shown by FIG. 27D. BMD was also increased by R2M3-26 as measured by DEXA, shown in FIG. 27E.

Figure 28A:
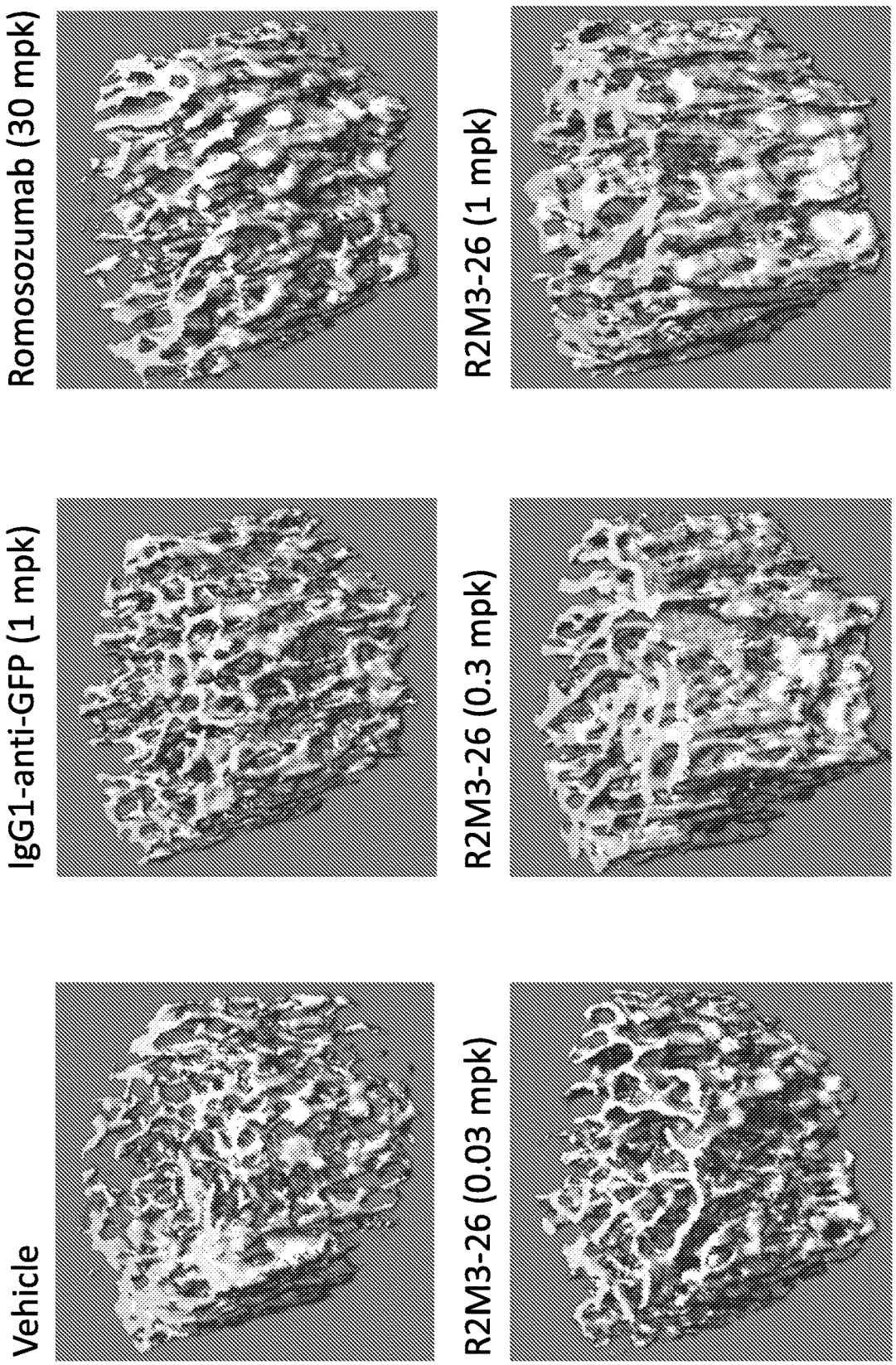
FIGS. 28A-28C. Images and graphs showing that a single injection of R2M3-26 rapidly increases bone volume.
Figure 28B:
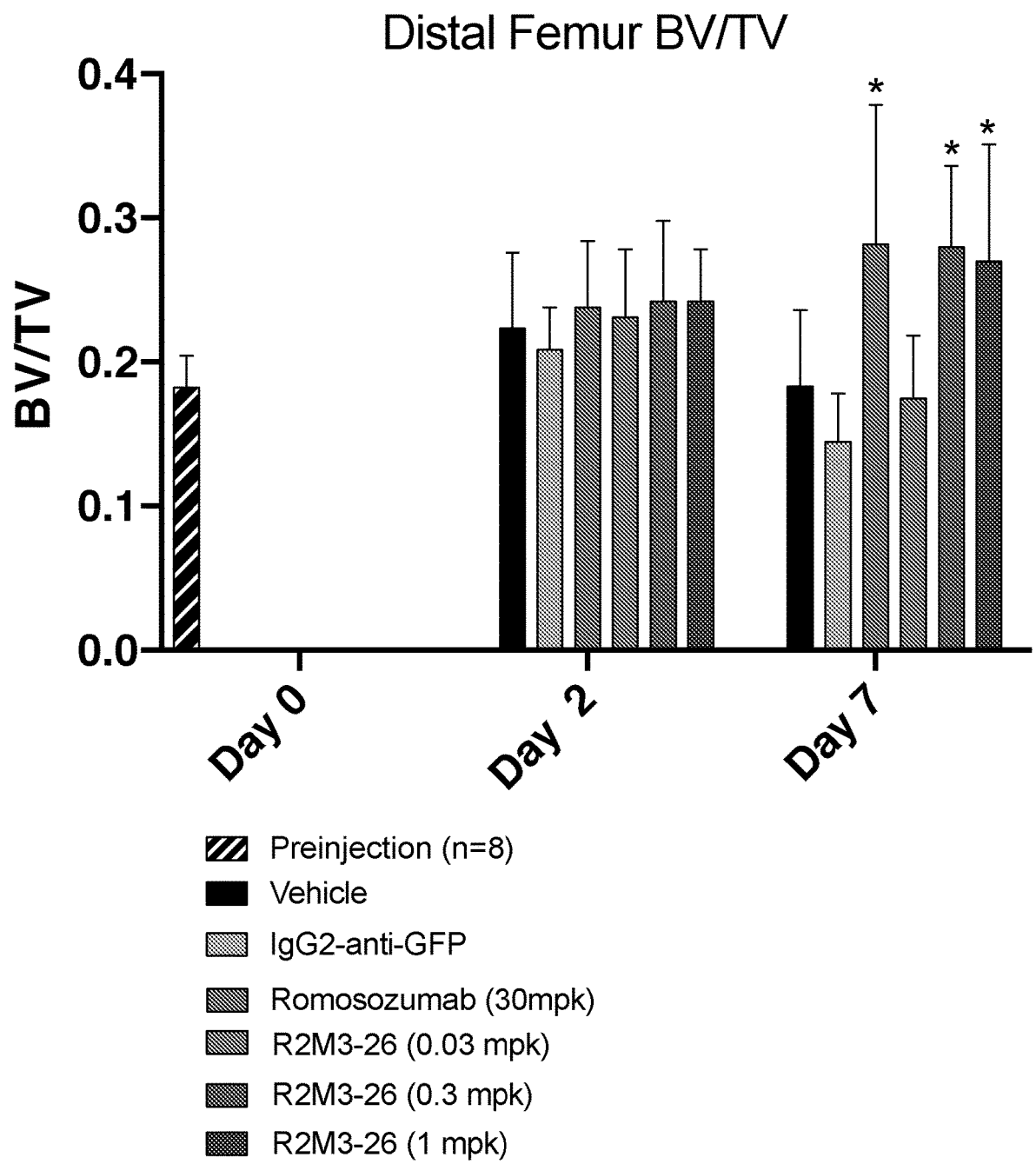
Figure 28C:
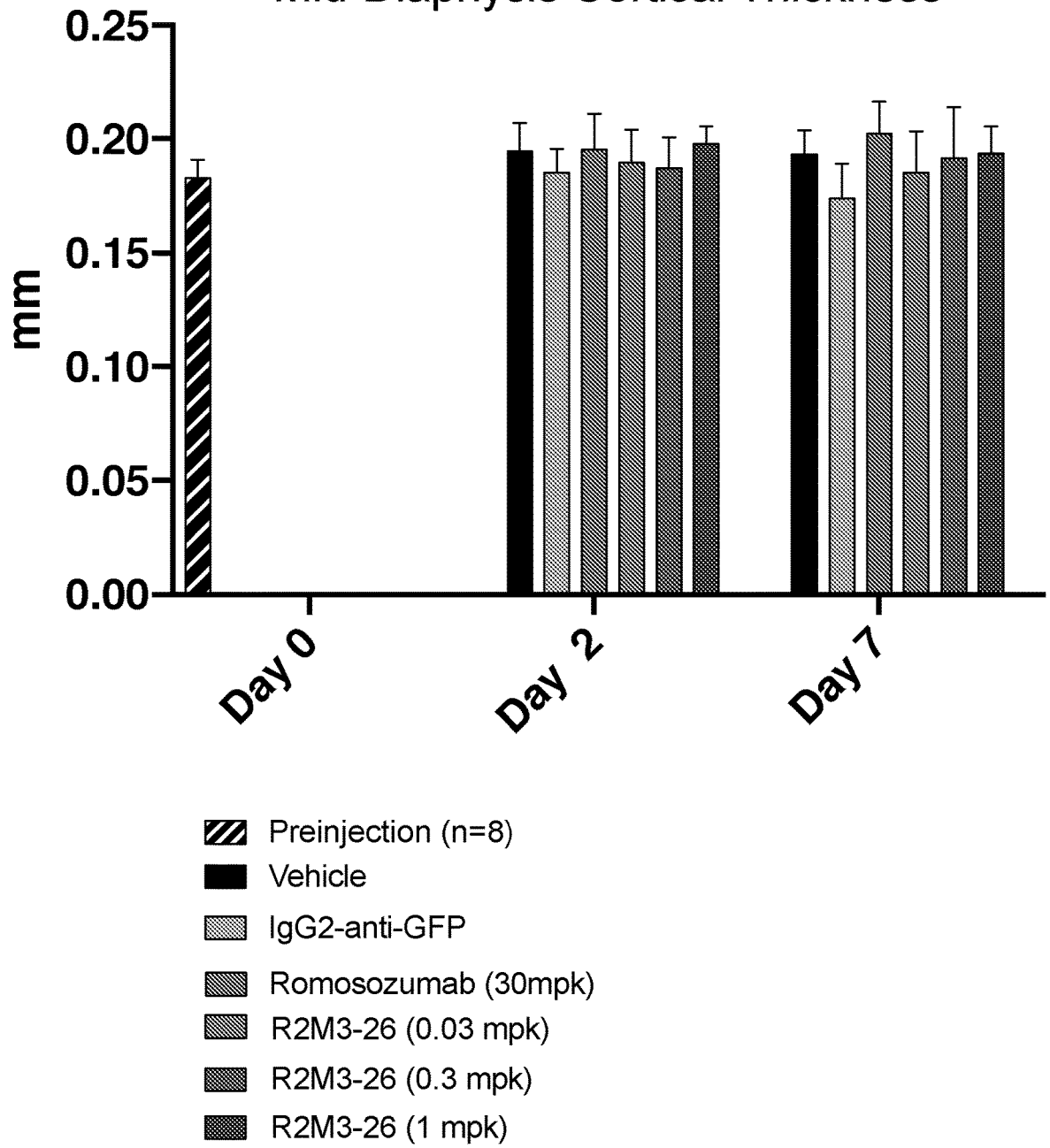
Figure 29A:
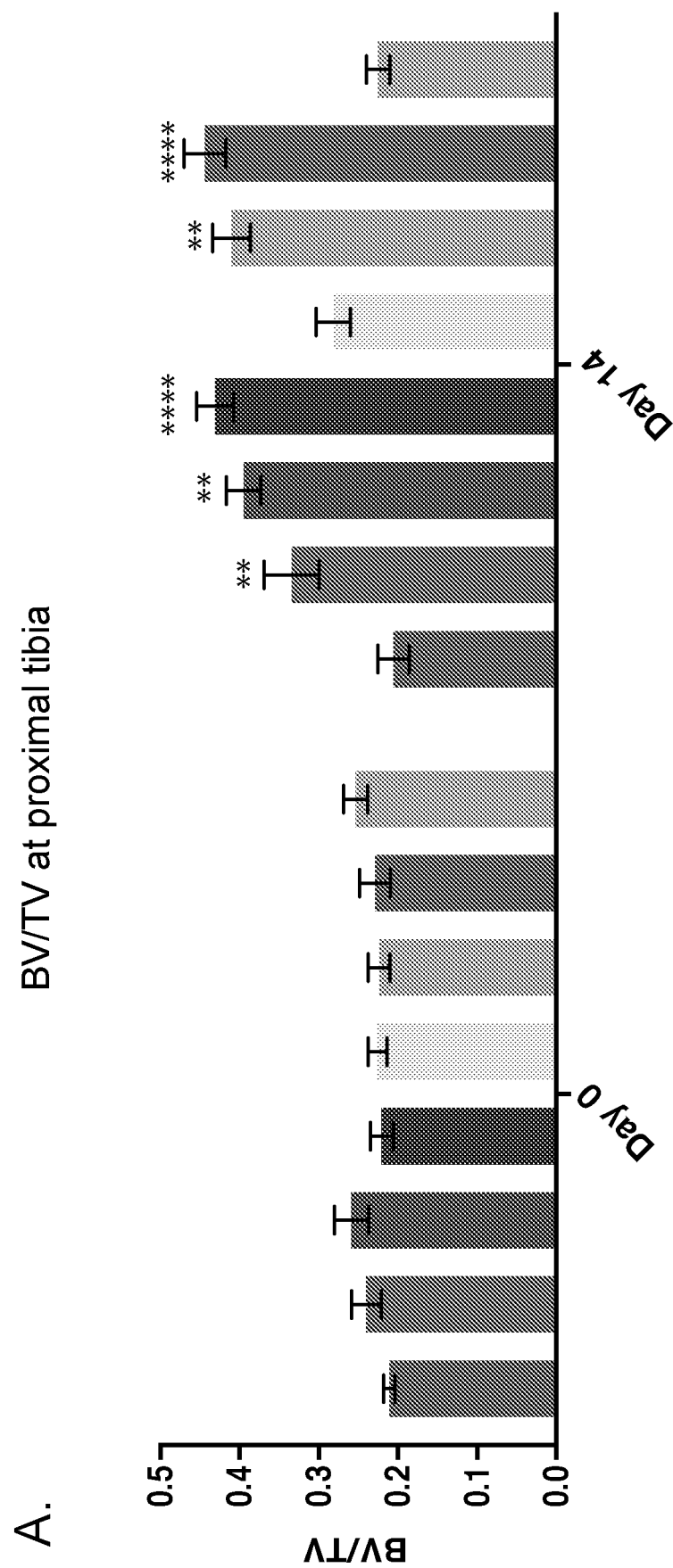
FIGS. 29A-29D. Graphs showing that high doses of R2M3-26 and 1R-C07-26 significantly and rapidly increase bone formation in naïve mice. For each timepoint, the bars from left to right correspond to the treatments indicated from top to bottom.
Figure 29B:
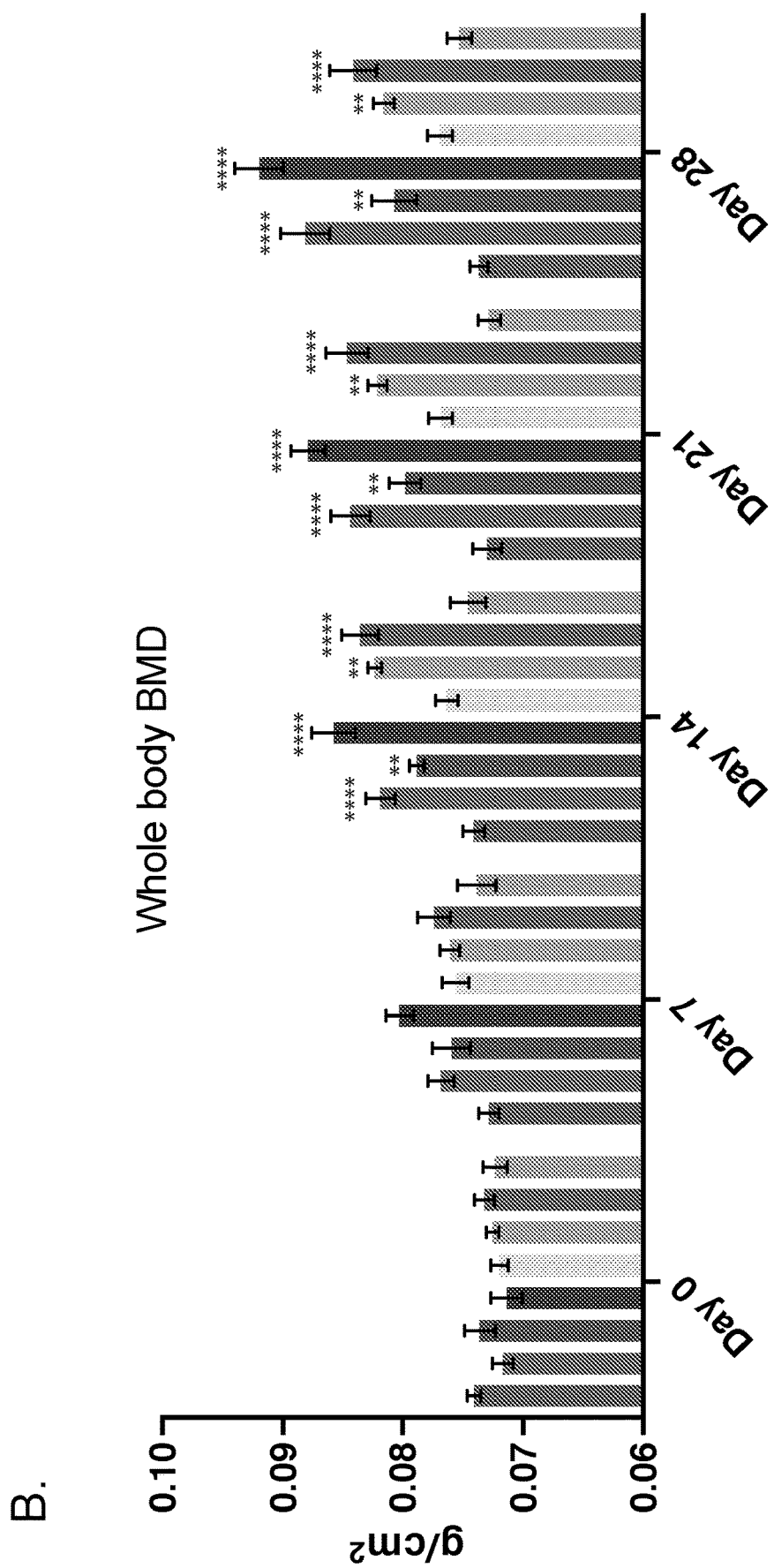
Figure 29C:
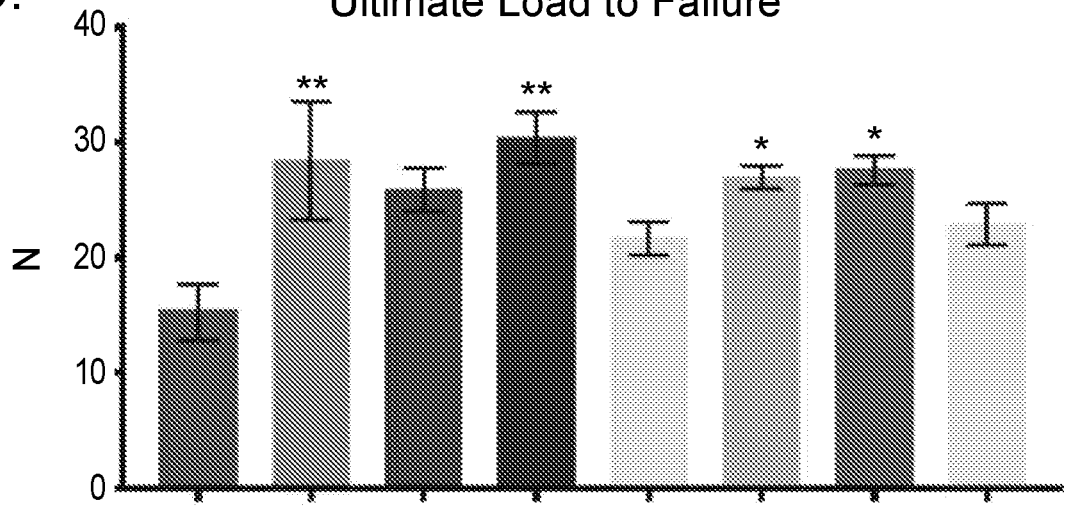
Figure 29D:
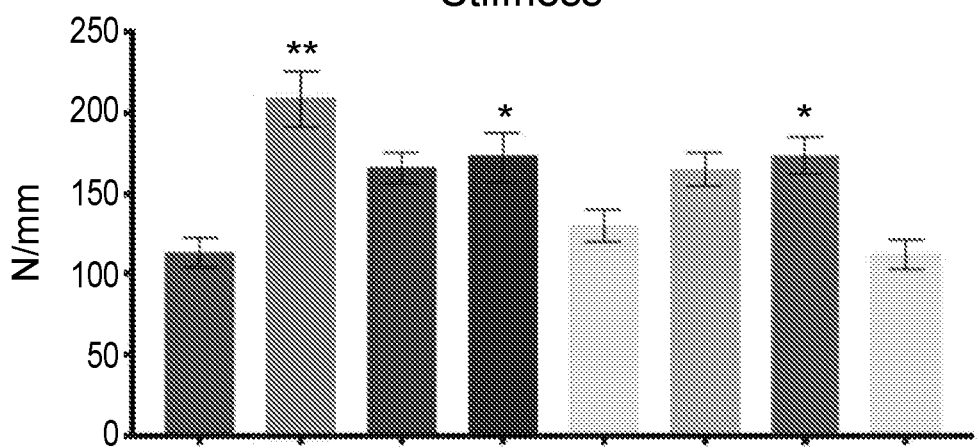
Figure 30:
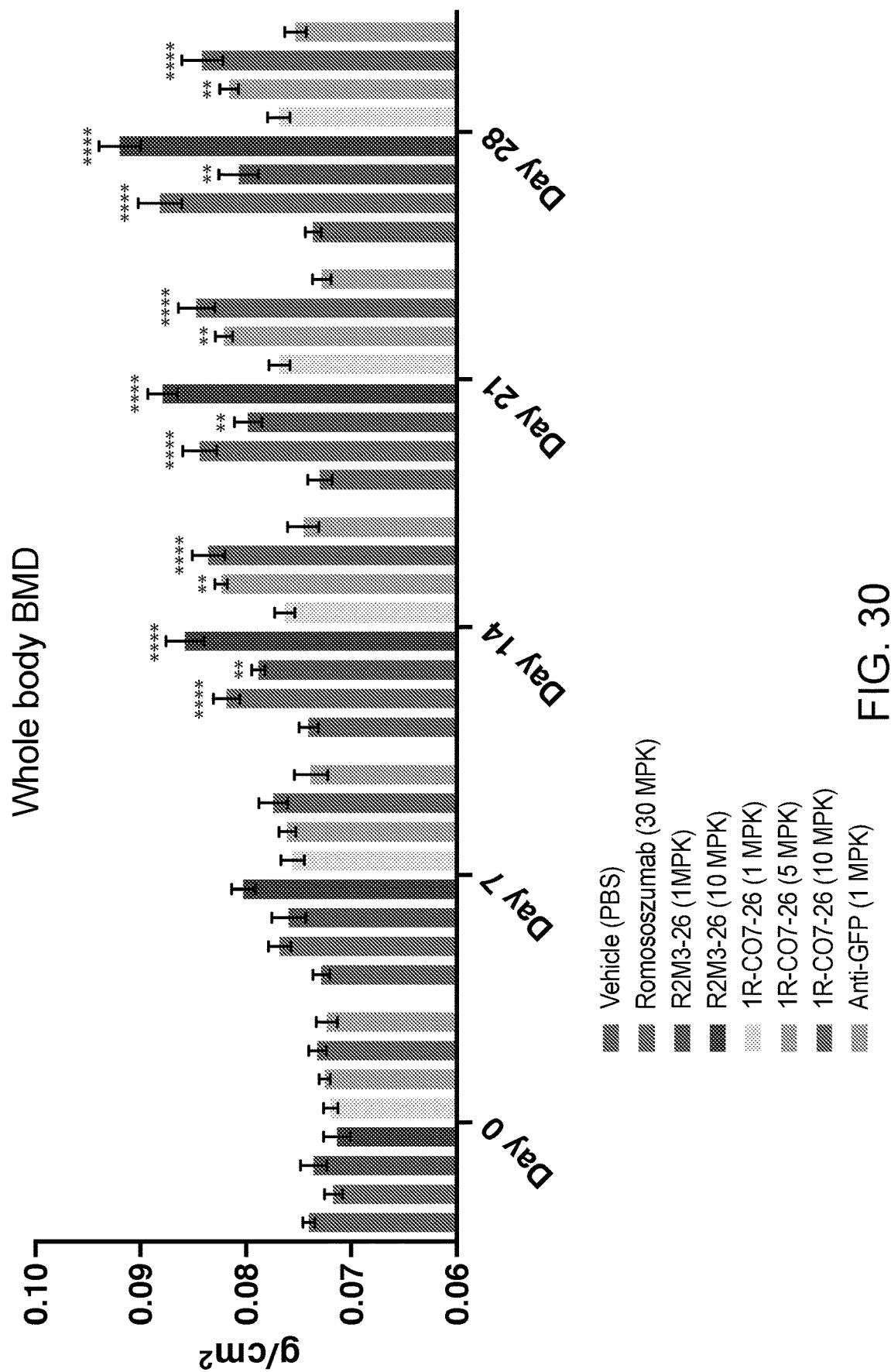
FIG. 30. Graphs showing that R2M3-26 and 1R-C07-3 increase bone mineral density in naïve mice. For each timepoint, the bars from left to right correspond to the treatments indicated from top to bottom.

A single injection of R2M3-26 was sufficient to induce rapid bone formation and bone volume within one week, as shown in FIGS. 28A-28C, wherein * indicates P value<0.05.

High dose treatment with R2M3-26 and 1R-C07-26 rapidly and significantly increased bone volume and bone mineral density, and improved biomechanical strength of the bone (ultimate load to failure and stiffness), as shown in FIGS. 29A-29D. 1R-C07-26 showed a robust and significant effect on bone accrual that persisted through 28 days. Both R2M3-26 and 1R-C07-26 significantly increased the resistance to fracture after 28 days of treatment by biomechanical testing.

High dose treatment with R2M3-26 and 1R-C07-3 rapidly and significantly increased bone volume, bone mineral density, and cortical thickness after only 14 days of treatment, as shown in FIG. 30A-E. 1R-C07-3 at 10 mpk appeared more effective at increasing bone mass than any other treatment tested in this preclinical model.

These studies demonstrate that recombinant protein treatment can induce rapid and sustained increase of bone mineral density and bone volume in naive mice and mouse osteoporosis model. Both bone volume and bone mineral density (BMD) increased rapidly, suggesting resistance to fracture. IgG2-anti-GFP is a negative control. Anti-Beta Galactosidase (anti-βgal) was a negative control.

An additional experiment was done to determine systemic skeletal effects of Wnt surrogate molecules in an ovariectomy-induced model of osteoporosis. 057BL/6 females, 4 weeks old at time of ovariectomy, (n=8/group) were compared to sham surgery operated as well as age-matched naïve mice. Animals were injected i.p. with recombinant Wnt surrogate molecules 7 months after surgery and when the onset of osteoporosis was confirmed. Experimental groups included R2M3-26, 1RC07-3, anti-Bgal (Ab control), and vehicle (PBS). Sub-cutaneous injection of romosozumab was done to another cohort of mice for comparison. Animal were treated twice weekly, and followed for 4 weeks.

Figure 31:
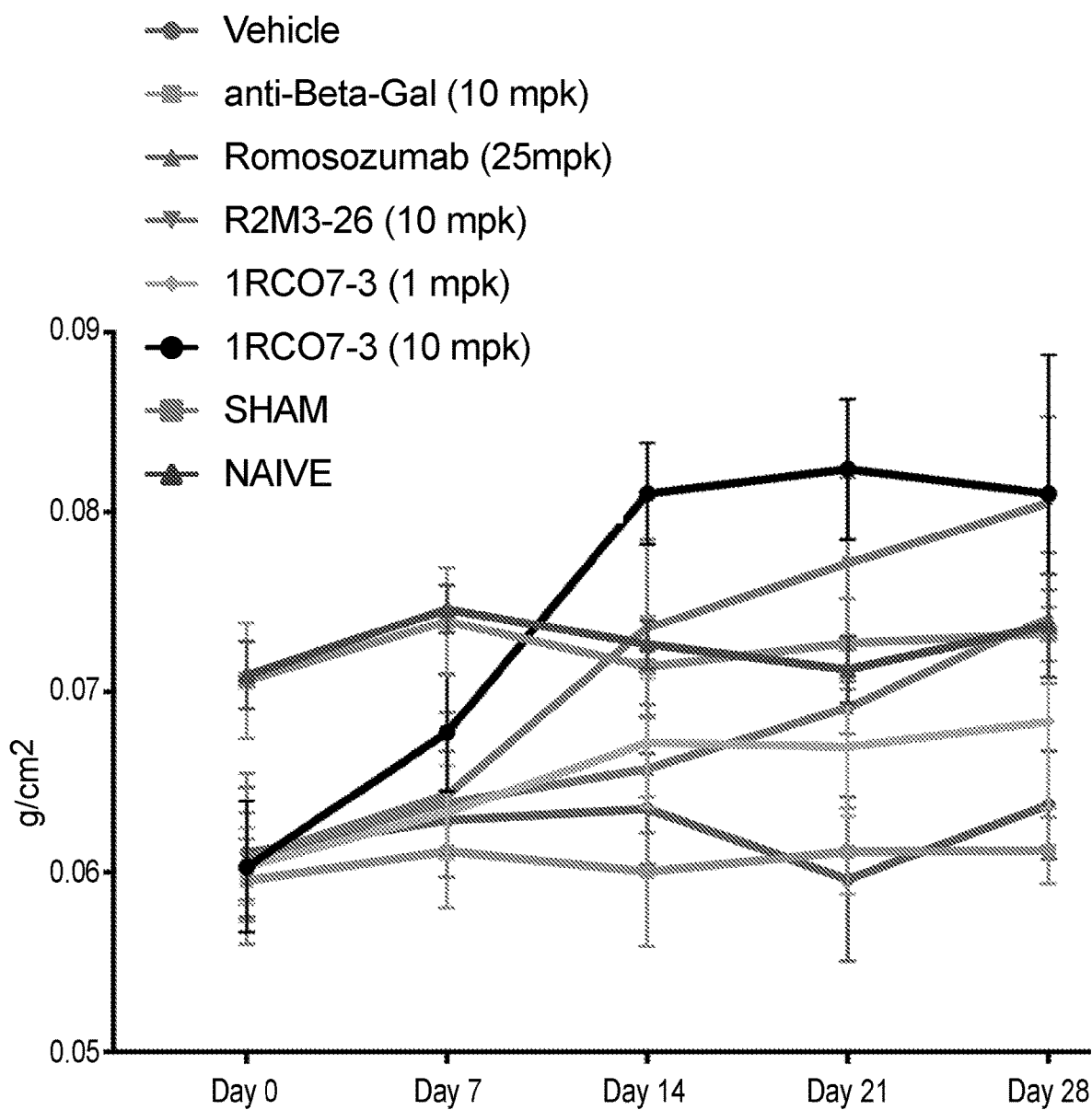
FIG. 31. Graph showing changes in whole body bone mineral density (BMD) measured weekly in ovariectomized mice as compared with naïve and sham surgery operated mice.

As shown in FIG. 31, whole body bone mineral density (BMD) was measured weekly using dual-energy X-Ray absorptiometry (DEXA) and treatment with Wnt surrogate molecules can not only reverse but even surpass the total BMD seen in naïve or non-surgical animals. After 4 weeks of treatment, animals were assessed for the vertebral resistance to compression fracture.

Figure 32:
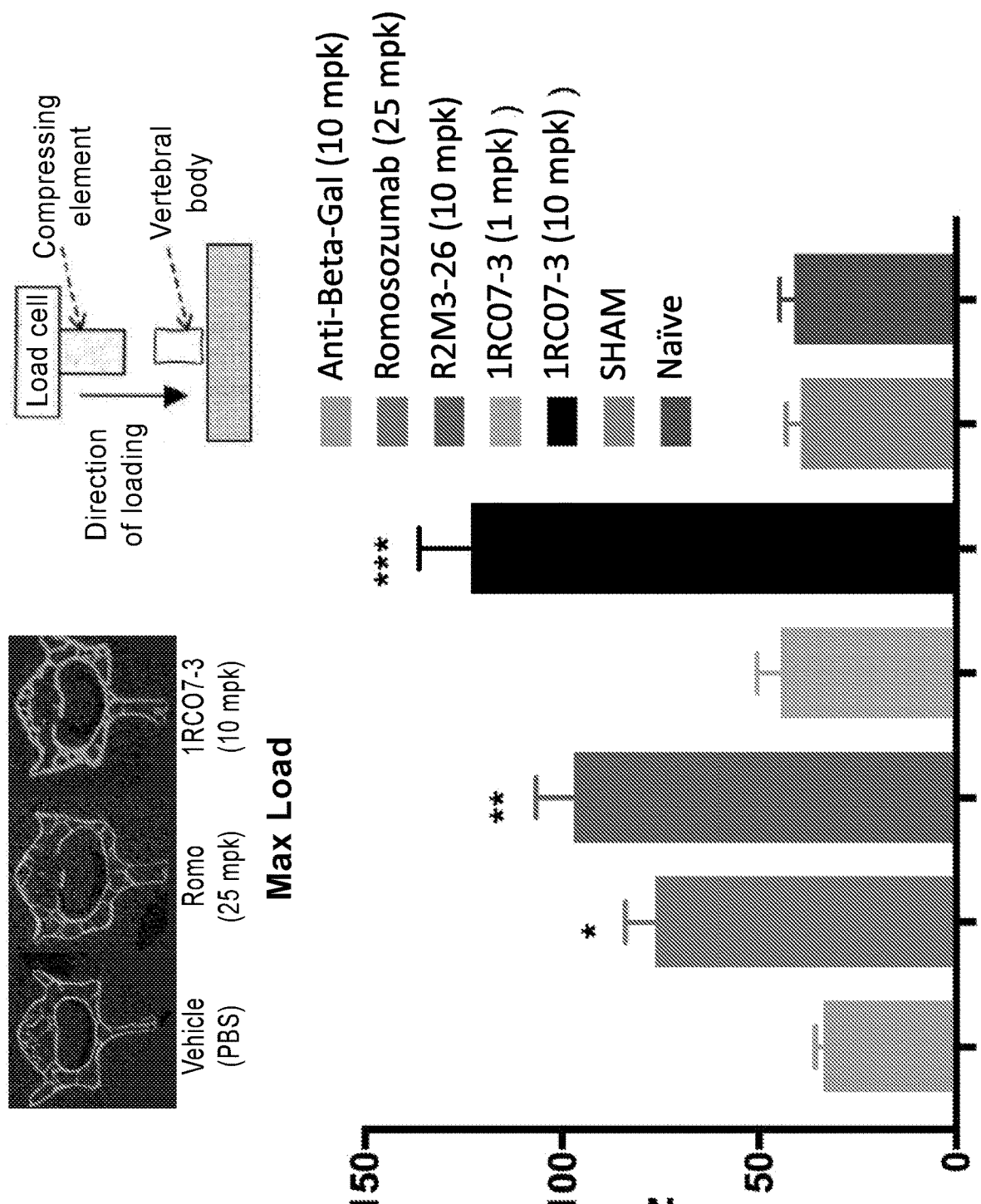
FIG. 32. Changes in vertebral mineral density (image shown) and changes the vertebral resistance to compression fracture in vertebra isolated from mice after various treatments (bar graph) as measured in newton units of force (N) after 4 weeks of treatment.

Treatment with Wnt surrogate molecules significantly increased the vertebral resistance to compression fracture, as shown by fracture analysis (FIG. 32). 1RC07-3 most robustly increases the Max Force required to compressively fracture the vertebra.

The Einhorn fracture model (Bonnarens F, Einhorn T A. J Orthop Res. 1984; 2(1):97-101.PMID: 6491805) with delayed treatment with Wnt surrogate molecules was used to determine ability of this therapy to induce fracture healing. Delayed treatment with either 1RCO7-3 or R2M3-26 was tested to determine if either molecule was capable of contributing to increased fracture healing after a mid-traverse femoral fracture. C57BL/6 females, 16 weeks old at time of fracture (n=8/group) were used. The presence of a cartilaginous callus 2 weeks after fracture was confirmed in all animals before the start of treatment. With delayed treatment to allow for callus formation, a pure osteogenic signal could be elicited, with rapid mineralization of the already existing callus.

Animals were injected i.p. with recombinant Wnt surrogate molecules with the following experimental groups: R2M3-26, 1RCO7-3, anti-Bgal (Ab control), and vehicle (PBS). Sub-cutaneous injection of romosozumab was done to another cohort of mice for comparison. Animal were treated twice weekly, and followed for 6 weeks. Radiography was used to visualize changes in mineralization of the callus throughout the experiment (FIGS. 33A and B). An increase in the mineralization and size of the resulting callus with Wnt surrogate treatment is apparent at both 1 and 6 weeks of treatment. One week was sufficient to induce rapid mineralization that is predictive of rapid bone fracture healing and resistance to fracture. 1RCO7-3 appeared to induce mineralization to a greater extent than R2M3-26. Radiographs taken after 6 weeks of treatment show the persistence of the highly mineralized callus in the 1RCO7-3 group, while some of the fracture callus in the R2M3-26 group has diminished (FIGS. 33B and D).

Figure 33C:
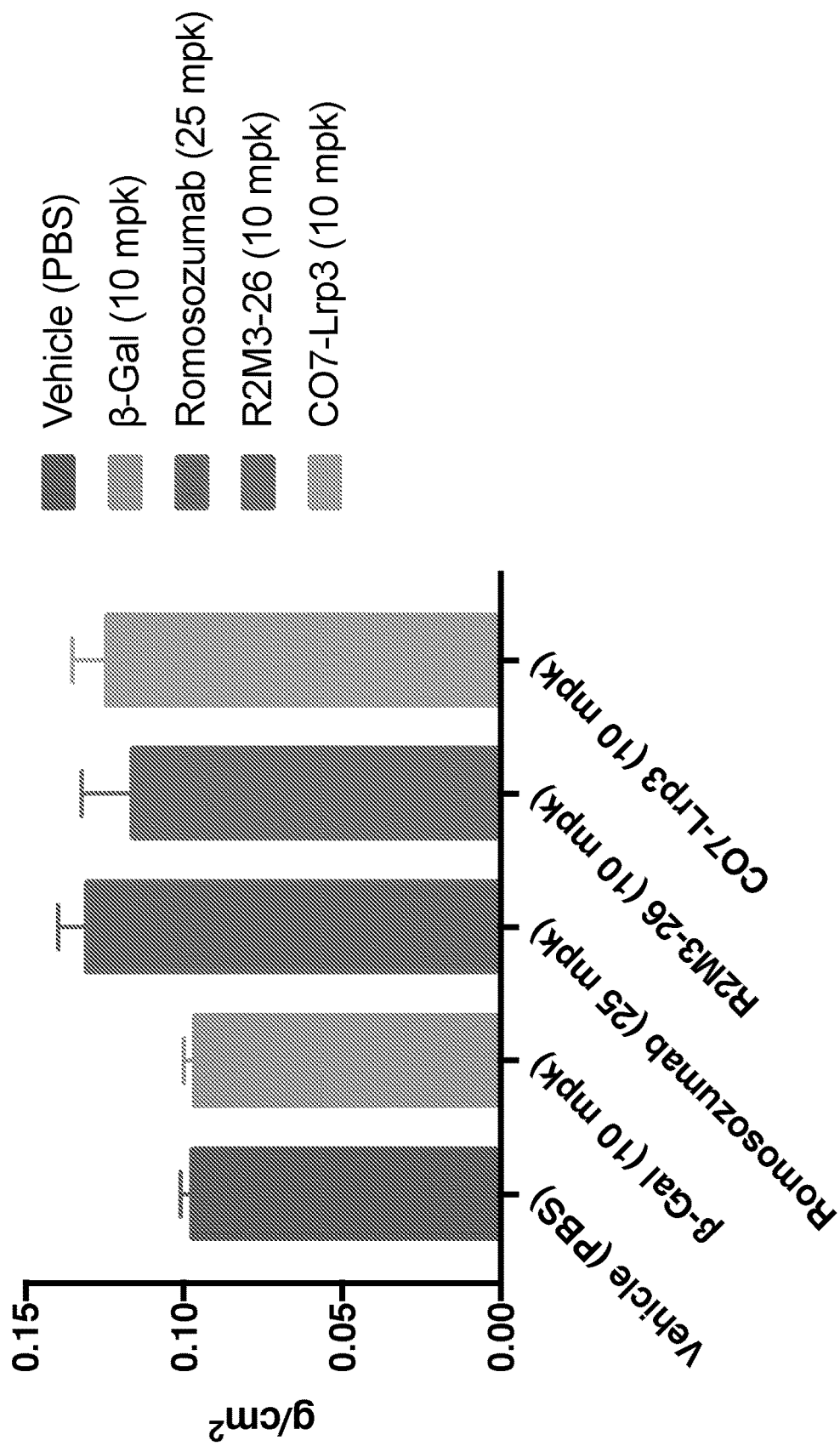

Whole body DEXA was measured throughout the experiment to examine bone mineral density in not only the fractured femur, but also the contralateral, non-fractured, femur where the expected increases in bone mineral density occurred after treatment (FIGS. 33C and D). This provides reduced risk of secondary fracture in the already fractured limb and the appendicular skeleton. BMD of contralateral femur at 42 days are shown in FIG. 33C.

Following 6-weeks of treatment after the confirmation of callus, we scanned the femurs with micro-computed tomography and determined multiple parameters which have been associated with an increased resistance to fracture after healing. Callus tissue volume, the bone volume within that callus, and especially bone mineral content are all significantly increased within the region of interest examined (FIG. 33D). Qualitatively, the reconstructions show the prevalence of thick osteoid and mineral within the treated fracture. These parameters suggest a robust resistance to fracture and indicate that delayed treatment with Wnt surrogate molecules, after the spontaneous cartilaginous callus formation, can initiate a rapid and significant increase in bone formation.

Figure 34:
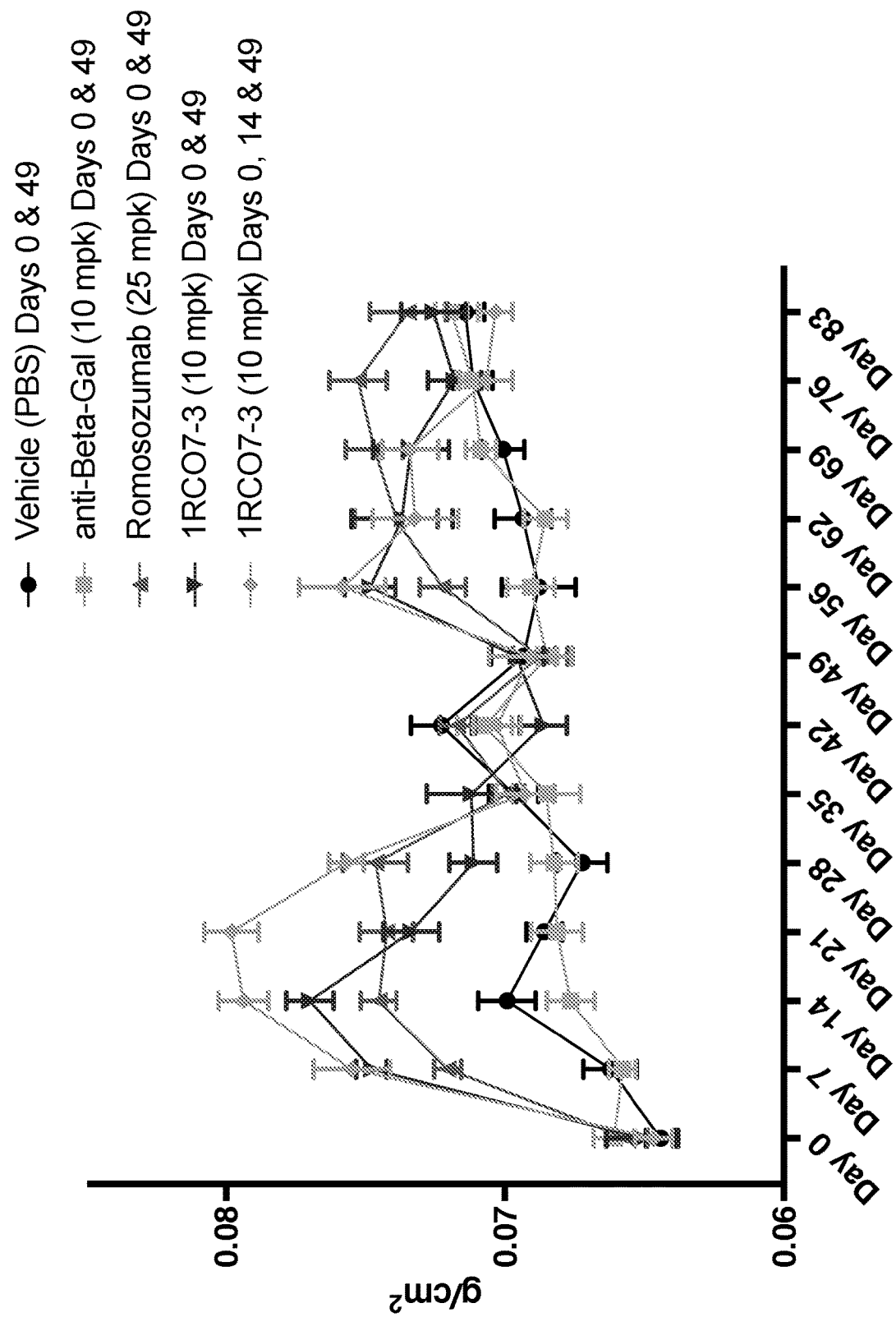
FIG. 34. Graph with changes in whole body bone mineral density (BMD) measured weekly with different Wnt surrogate molecule dosing schedules is shown.

In another experiment, the dosing schedule was tested to determine whether Wnt surrogate molecule therapy can induce a significant bone anabolic effect, how long that effect persists, and after washout, to determine how the bone responds to additional treatment. Systemic skeletal effects were compared with variable dosing of 1RCO7-3 on anabolic effect, washout, and redosing after establishing baseline. C57BL/6 females, 12 weeks old (n=8/group) were injected i.p. with recombinant Wnt surrogate molecules with the following experimental groups: two groups with 1 RCO7-3, one with anti-βgal (Ab control), and one with vehicle (PBS) on day 0 of the experiment. Sub-cutaneous injection of romosozumab was done to another cohort of mice on day 0 for comparison (romosozumab is an anti-sclerostin antibody (Saag et al., N Engl J Med. 2017 Oct. 12; 377(15):1417-1427; PMID:28892457) that may reverse the bone loss associated with osteoporosis). Animals in 1 RC07-3 treated groups had significant and rapid induction of bone formation by 14 days (FIG. 34). One group received a second injection at day 14 to determine if the bone anabolic effect could be further enhanced. Interestingly, regardless of treatment, all treatment effects were reversed and normalized after 35 days. A 2-week period was allowed to return to baseline levels prior to a second round of treatment. On day 49, a second round of treatment was done to all experimental groups. The Wnt surrogate treated animals responded rapidly, however not to the same magnitude as with the initial treatment (FIG. 34). For all groups, 5 weeks after the last injection, new bone formation ceased. This indicates that a single injection is capable of significantly increasing bone formation, however the anabolic effect is rapidly lost. This suggests that an anti-resorptive agent may be required in combination with Wnt surrogate therapy to maintain the anabolic effect.

The mechanism of action of romosozumab relies upon the stimulation of bone formation by removing an inhibitor (sclerostin) of endogenous Wnt signaling. An experiment was done treating animals with Wnt surrogate molecules plus romosozumab to determine if Wnt surrogate molecule treatment was capable of synergizing with romosozumab in a combination study.

C57BL/6 males, 10 weeks old (n=8/group) were injected i.p. with recombinant Wnt surrogate molecules in combination with romosozumab in the following experimental groups: 1RC07-3 (0.1 mpk), 1RCO7-3 (1 mpk), 1RCO7-3 (10 mpk), 1RCO7-3 (0.1 mpk)+romosozumab (25 mpk), 1RCO7-3 (1 mpk)+romosozumab (25 mpk), 1RCO7-3 (10 mpk)+romosozumab (25 mpk), romosozumab (25 mpk) alone, anti-Bgal (Ab control), and vehicle (PBS). Animals were treated twice weekly and followed for 3 weeks.

Figure 35:
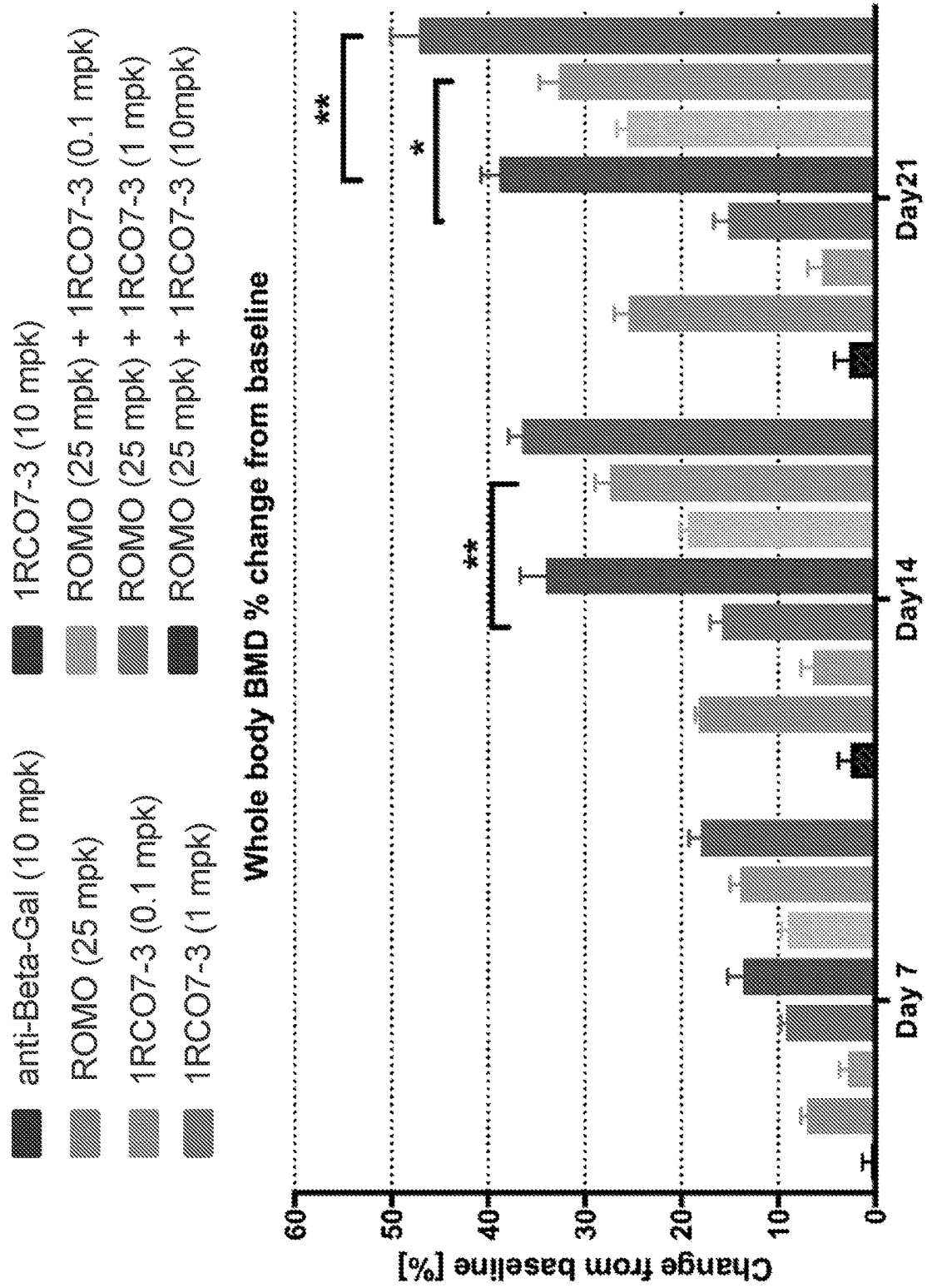
FIG. 35. Graph with changes in whole body bone mineral density (BMD) measured weekly from mice treated with different Wnt surrogate molecule alone and in combination with Romosozumab is shown.

Whole body BMD was measured weekly and results are presented in FIG. 35. Conclusions from this study are that endogenous romosozumab can stimulate additional bone growth in the presence of high dose 1 RC07-3. These data further suggest that peak anabolic action has not yet been reached with 10 mpk 1RCO7-3 treatments. These data also show that romosozumab can stimulate bone formation even in the presence of 1RCO7-3. Overall, This study shows that Wnt surrogate molecule treatment can synergize with romosozmab to enhance the bone anabolic effect after only 21 days of twice weekly treatment.

Figure 36:
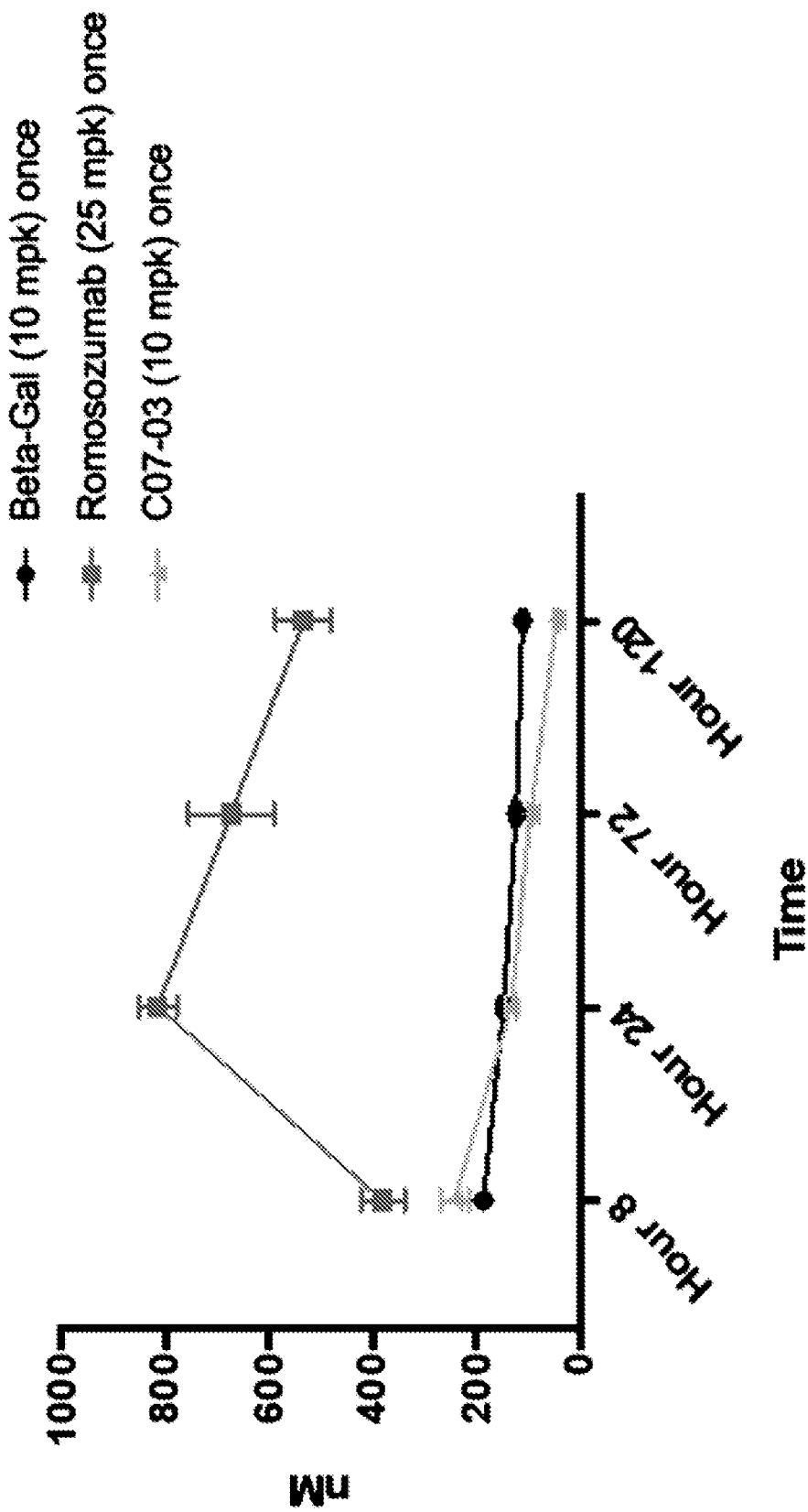
FIG. 36. Levels of therapeutic molecules in serum as measured by ELISA. These data accompany gene expression data presented in Table 4.

Changes in gene expression in whole bone were measured in a time course after Wnt surrogate molecule therapy in mice to assess how this therapy regulates expression of genetic markers related to proliferation and osteogenesis. C57BL/6 females, 13 weeks old (n=5/group) were injected i.p. with 1RCO7-3 or anti-Bgal (Ab control) once. Sub-cutaneous injection of romosozumab was done to another cohort of mice for comparison. Cohorts of animals were sacrificed at 8, 24, 48 and 120 hours after treatment, and tibia bones and serum were isolated and flash frozen for RNA extraction. ELISA was used to measure levels of therapeutic molecules in serum over the course of the experiment as described above (FIG. 36).

For purification of RNA from bone, the excised tibia from freshly sacrificed animals were processed as follows: the ends of the tibia were clipped to expose marrow cavity and marrow cavity was flushed with ice cold saline through 30 gauge needle, Steps were taken to ensure all muscle tissue and cartilage has been removed; bone appeared completely white with no red marrow component residual. Tibias were placed in 1.5 mL Eppendorf tubes and flash frozen in liquid nitrogen. To lyse, a single tissue lyser bead was placed in the tube with bone and Trizol was added directly to frozen bone and bead. Tissue lyser at high speed was used to completely homogenize. Homogenates were then subject to chloroform extraction to separate the nucleic acid phase. Further isolation and purification was carried out using an RNeasy mini kit (Qiagen).

RNA Isolated from tibias was tested for relative transcript levels of Runt Related Transcription Factor 2 (RunX2), Collagen Type I Alpha 1 Chain (Col1A1), Dentin Matrix Acidic Phosphoprotein 1 (Dmp1), Alkaline phosphatase (Alp), Receptor activator of nuclear factor kappa-B ligand (RankL), Dickkopf WNT Signaling Pathway Inhibitor 1 (Dkk1), sclerostin (Sost), Cyclin D1 (Ccnd1), Axin2, and Ki67.

TABLE 4

Changes in gene expression in bone with Wnt surrogate molecule (1RC07-3) and romosozumab (Rxmab) Therapy in mice

| gene | Time(hr) | Bgal | Rzmab | 1RC073 |
|---|---|---|---|---|
| RunX2 | 24 | 1.0 +/− 0.3 | 8.8 +/− 4.4 | 9.6 +/− 3.6** |
|  | 48 | 1.0 +/− 0.7 | 1.9 +/− 1.0 | 1.5 +/− 0.5 |
| ColA1 | 24 | 1.0 +/− 0.2 | 3.9 +/− 2.0 | 3.0 +/− 1.0 |
|  | 48 | 1.0 +/− 0.5 | 7.0 +/− 3.3 | 2.7 +/− 1.5 |
| Dmp1 | 24 | 1.0 +/− 0.2 | 2.7 +/− 1.1 | 4.8 +/− 2.9 |
|  | 48 | 1.0 +/− 0.6 | 1.6 +/− 0.7 | 3.8 +/− 1.8 |
| Alp | 24 | 1.0 +/− 0.4 | 18.3 +/− 11.7 | 16.5 +/− 6.4* |
|  | 48 | 1.0 +/− 0.6 | 4.0 +/− 1.8 | 5.0 +/− 1.9 |
| RankL | 24 | 1.0 +/− 0.3 | 8.6 +/− 4.5 | 8.7 +/− 3.3 |
|  | 48 | 1.0 +/− 0.7 | 1.5 +/− 0.6 | 4.3 +/− 1.4 |
| Dkk1 | 24 | 1.0 +/− 0.2 | 10.5 +/− 5.1 | 17.9 +/− 6.0** |
|  | 48 | 1.0 +/− 0.5 | 4.3 +/− 2.5 | 2.8 +/− 1.3 |
| Sost | 24 | 1.0 +/− 0.2 | 2.1 +/− 1.0 | 2.5 +/− 0.9 |
|  | 48 | 1.0 +/− 0.6 | 5.1 +/− 2.3 | 9.0 +/− 4.2** |
| Ccnd1 | 24 | 1.0 +/− 0.4 | 3.3 +/− 0.8 | 3.4 +/− 1.8 |
|  | 48 | 1.0 +/− 0.6 | 2.5 +/− 1.2 | 2.4 +/− 1.2 |
| Axin2 | 24 | 1.0 +/− 0.5 | 3.2 +/− 1.1 | 6.1 +/− 1.8** |
|  | 48 | 1.0 +/− 0.8 | 3.6 +/− 2.3 | 4.6 +/− 1.6* |
| Ki67 | 24 | 1.0 +/− 0.3 | 7.7 +/− 4.3 | 10.0 +/− 3.2 |
|  | 48 | 1.0 +/− 0.5 | 1.0 +/− 0.5 | 25.5 +/− 12.2 *** |

* $p<0.05$, ** $p<0.005$, 2-way ANOVA comparison with Bgal control
*** $p<0.001$, 2-way ANOVA comparison with both Bgal and romosozumab In comparison to anti-sclerostin antibody (romosozumab) treatment, gene expression signatures over the time points were distinct with Wnt surrogate molecule therapy, with induction of more robust Axin2 and Ki67 expression than that caused by romosozumab treatment.

Example 22

In Vivo Liver Regeneration Model and Characterization of AAV-Delivered Wnt Surrogates In vivo experiments were conducted by infecting approximately 8-weeks old C57BL/6J mice with an AAV vector that expressed Flag- and His-tagged 18R5-DKK1c protein (AAV-18R5-DKK1c-FlagHis). 18R5-DKK1c is a fusion protein containing the frizzled binding antibody, 18R5, in scFv format fused to DKK1c, as described in PCT Publication WO2016/040895, e.g., FIG. 5. Control mice were either injected sub-cutaneously with phosphate-buffered saline (PBS) only or romosozumab (10 mg/kg), or injected intravenously (IV) with an AAV vector that expressed green fluorescent protein (GFP) (AAV-CAG-GFP), or an AAV vector that expressed a fusion protein comprising an anti-GFP scFv fused to a mutant DKK1c (AAV-ScFv (anti-GFP)-DKK1cF234K-Flag-His). 28 days after infection, animals were weighed and sacrificed. The liver was weighed, and the liver to body weight ratio calculated. The content of the small intestine and colon was removed by flushing with phosphate-buffered saline and gentle pressure to expel the content. The small intestine and colon were then weighed.

Figure 37:
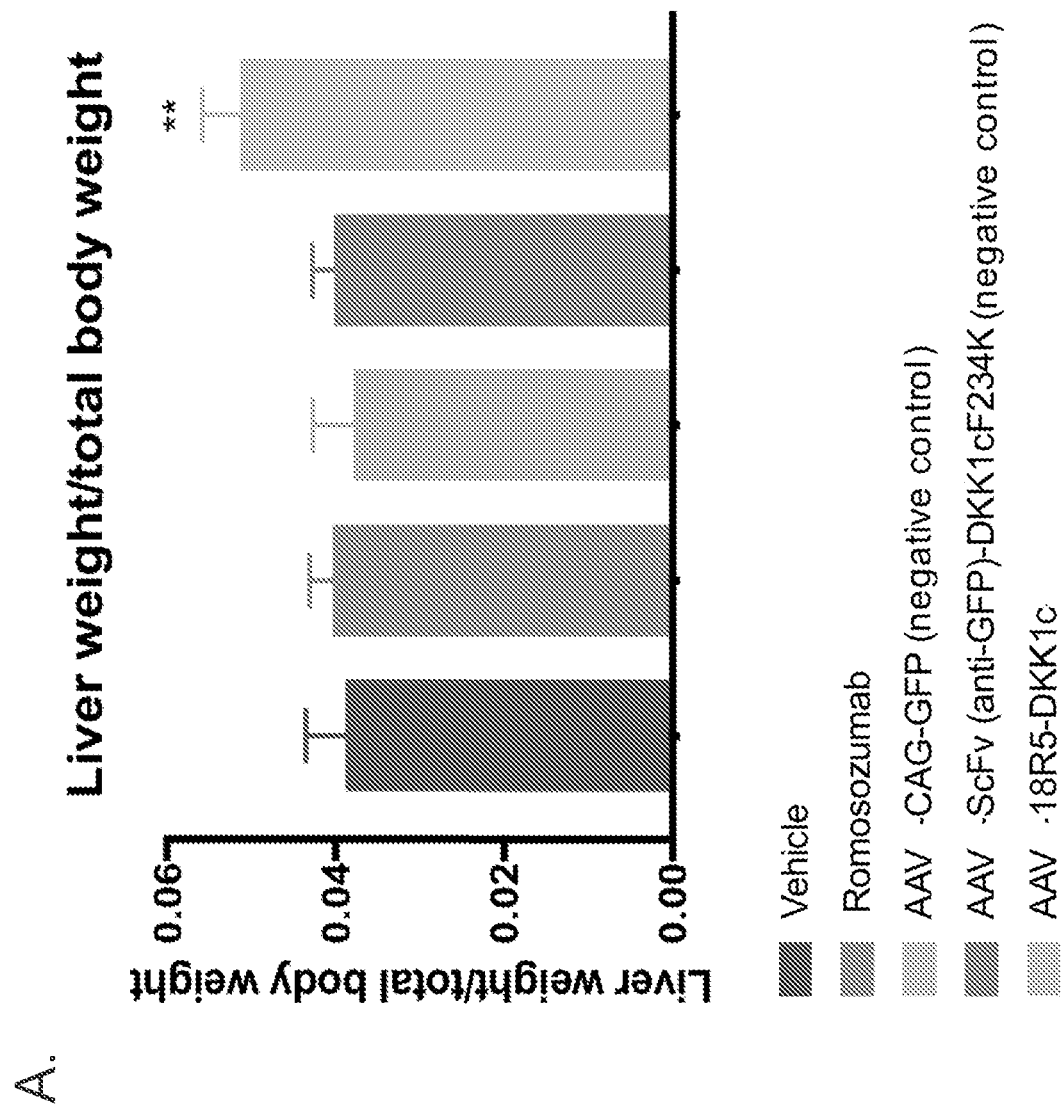
FIGS. 37A-37C. Liver (A), small intestine (B) and colon (C) to body weight ratio after treatment with AAV-delivered Wnt surrogates. (**) p<0.01. For each graph, the treatments shown from left to right correspond to those in the legend from top to bottom.

Systemic expression of 18R5-DKK1c-FlagHis resulted in a significant liver weight increase (FIG. 37A). Systemic expression of the negative controls, eGFP or anti-eGFP-Dkk1cF234K, did not affect the liver to body weight ratio. Administration of the romosozumab recombinant protein or vehicle control, did not affect the liver to body weight ratio.

None of the treatments affected the small intestine (FIG. 37B) or colon (FIG. 37C) to body weight ratio.

These studies showed that 18R5-DKK1c-FlagHis increases liver weight, but not that of the small or large intestines. This suggests that 18R5-DKK1c-FlagHis can promote liver regeneration.

Example 23

In Vivo Liver Regeneration Model and Characterization of Recombinantly Produced Wnt Surrogates In vivo experiments were conducted by treating mice with recombinantly produced anti-eGFP, R2M3-26, 1R-C07-26, romosozumab or Rspo2 proteins at various dosages. The Rspo2 protein is a fusion protein between a short splice variant of the Rspo2 gene and a human Fc fragment.

In one study, mice were housed 4 per cage and n=8 per treatment group were used. Approximately 8-weeks old C57BL6/J mice were administered recombinant proteins, anti-eGFP (1 mg/kg), R2M3-26 (1 or 10 mg/kg) or 1R-C07-26 (1, 5 or 10 mg/kg), twice weekly intra-peritoneally (i.p.) for four weeks. In addition, groups of mice were administered romosozumab (30 mg/kg) or PBS vehicle control, subcutaneously.

Figure 38:
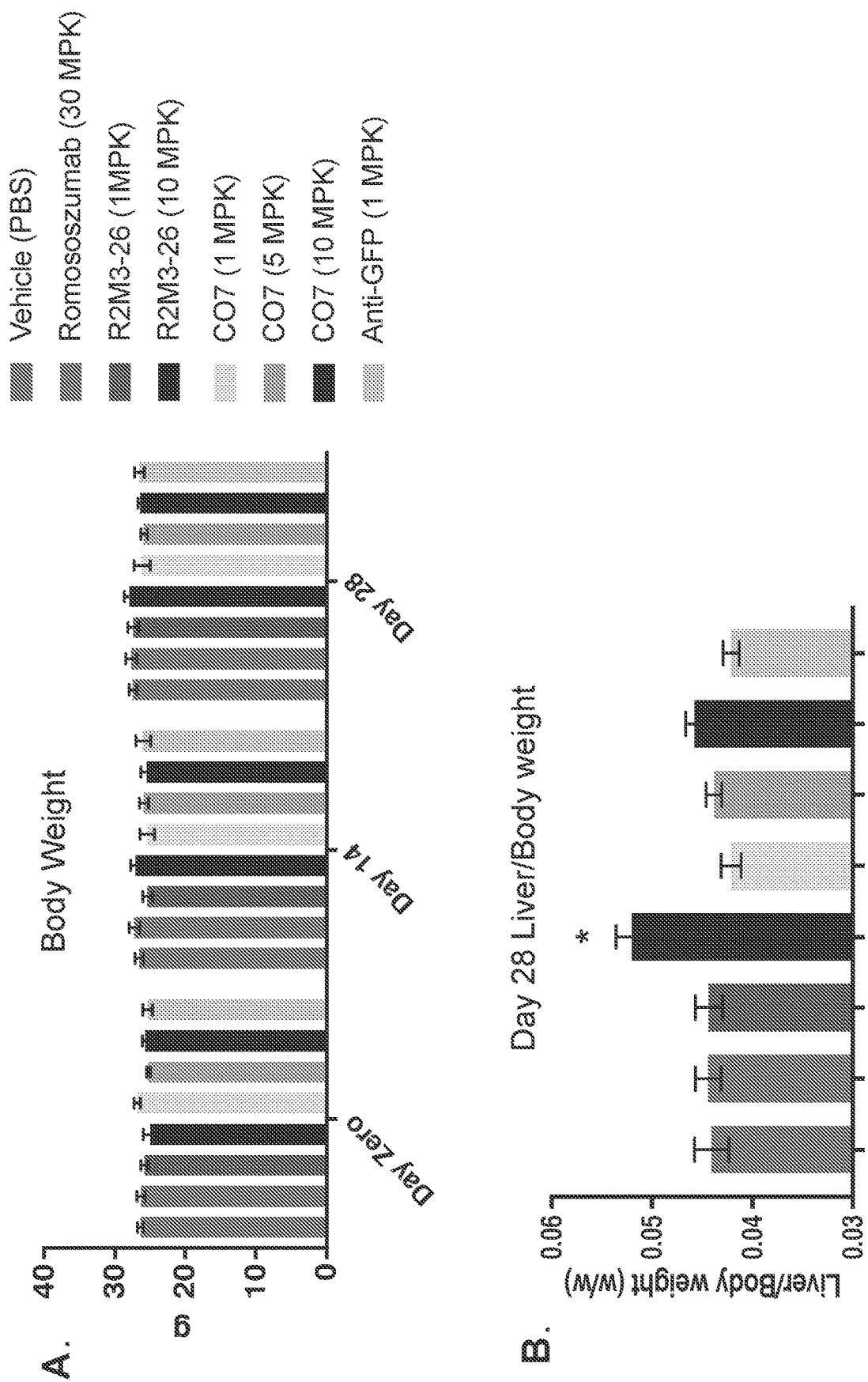
FIGS. 38A-38B. Body weight (A) and liver to body weight (B) ratio after treatment with recombinantly produced Wnt surrogate proteins. (*) p<0.05. For each time point, the treatments shown from left to right correspond to those in the legend from top to bottom.

Mice were weighed at the beginning and throughout the treatment. None of the treatment with recombinant proteins affected total body weight significantly (FIG. 38A). On day 28, the liver was weighed, and the liver to body weight ratio calculated (FIG. 38B). The highest dose of R2M3-26 (10 mg/kg) resulted in a significant increase in liver to body weight ratio. None of the other treatment affected the liver weight significantly.

The increase in liver weight in response to R2M3-26 suggest that this recombinant protein can promote liver regeneration.

In another study, mice were housed 5 per cage and n=10 per treatment group were used. Approximately 8-weeks old C57BL/6J mice received a single i.p. injection containing anti-eGFP (0.56 mg/kg), R2M3-26 (0.3 mg/kg) or Rspo2 (0.46 mg/kg) alone, or with a combination of R2M3-26 (0.1 mg/kg) and Rspo2 (0.46 mg/kg).

24 or 48 hours after injection, mice were euthanized. A portion of the left liver lobe was snap-frozen in liquid nitrogen and stored at −80° C. for RNA analysis. Cyclin D1 and Ki67 expression were measured by performing qPCR using the Mm00432359_m1 Ccnd1 probe and the Mm01278617_m1 Ki67 probe (Thermofisher, 4331182). An additional portion of the left liver lobe was fixed in formalin and embedded in paraffin for immunohistochemistry analysis. Sections were stained with the anti-proliferating cell nuclear antigen (PCNA) (Abcam, ab18197) or anti-phospho-histone H3 (pH3) rabbit antibodies (Abcam, ab47297). The number of positive nuclei were counted using the image processing software, Image J.

Figure 39:
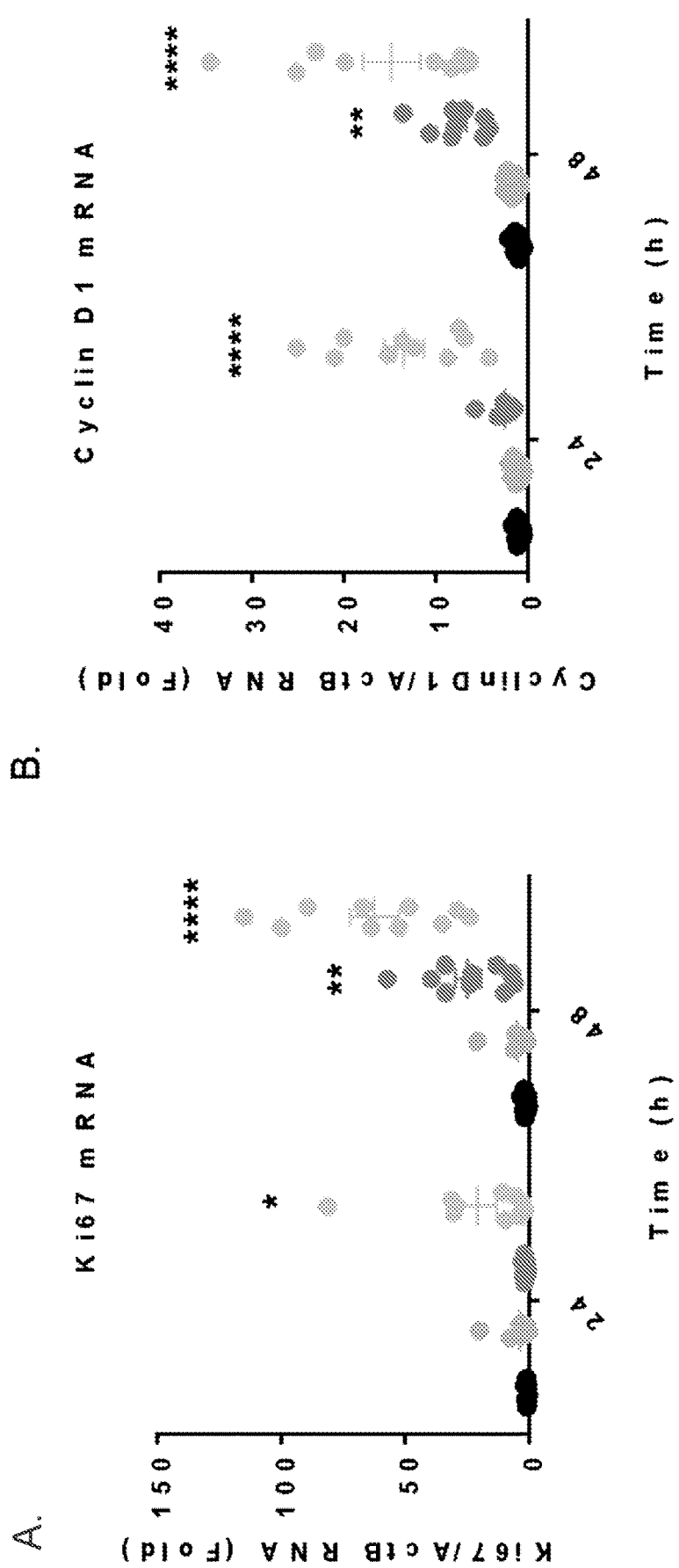
FIGS. 39A-39D. Induction of proliferation markers in response to R2M3-26 and Rspo2 recombinant proteins. Liver Ki67 (A) and cyclinD1 (B) mRNA expression. Average count of PCNA (C) or phospho-histone H3 (D) positive nuclei per 10× field after immunohistochemistry staining with PCNA and phospho-histone H3 antibodies respectively. (*) p<0.05, () p<0.01, (*) p<0.001, (****) p<0.0001. For each time point, the treatments shown from left to right correspond to those in the legend from top to bottom.

Rspo2 alone increased Ki67 (FIG. 39A) and CyclinD1 (FIG. 39B) mRNA expression. In combination with R2M3-26, Rspo2 increased Ki67 and CyclinD1 expression further than with Rspo2 alone at 24 and 48 hours after treatment with recombinant proteins. Rspo2 alone increased the number of PCNA (FIG. 39C) and pH3 (FIG. 39D) positive nuclei in liver sections. In combination with R2M3-26, Rspo2 increased the number of PCNA and pH3 positive nuclei further than with Rspo2 alone at 48 hours after treatment with recombinant proteins.

These studies show that the proliferation markers, Ki67 mRNA, CyclinD1 mRNA and PCNA-positive nuclei, and the pH3 mitotic marker are induced by the R2M3-26 and Rspo2 recombinant proteins and suggest that these recombinant proteins can promote liver regeneration.

Example 24

In Vivo Chronic Liver Injury Model and Characterization of AAV-Delivered Wnt Surrogates Two in vivo experiments were conducted in two, thioacetamide (TAA)- and CC14-induced, liver cirrhosis mouse models, thioacetamide (TAA)- and CC14-induced, to test the effect of AAV vectors expressing 18R5-DKK1c-FlagHis or Rspo2 protein on chronic liver injury. TAA was added to the drinking water of 6 weeks old C57BL/6J mice at a concentration of 300 mg/L throughout the TAA treatment duration. Mice were housed 5 per cage and groups of n=10 were used, except for the control groups without TAA treatment where n=5 per group was used.

In Study 1 (FIGS. 40A, 40C, 40E, 40G-H), mice with (n=10) or without (n=5) TAA treatment were weighed and sacrificed after 9 weeks of TAA addition into the drinking water, to measure baseline values. Livers were weighed and liver samples were collected for mRNA and histological analysis. TAA supplementation was maintained in the drinking water of the remaining mice and they were injected IV with AAV vectors that expressed an enhanced green fluorescent protein (eGFP) (3e10 genomic particles (GC)), 18R5-DKK1c-FlagHis (3e10 or 1e11 GC) or Rspo2 protein (1e11 GC) or a combination of 18R5-DKK1c-FlagHis (3e10 GC) and Rspo2 (1e11 GC). 5 age-matched naïve animals (no TAA) were kept as a negative control. Three weeks after AAV injection, all mice were weighed and euthanized. Livers were weighed and liver samples were collected for mRNA and histological analysis.

Treatment with 18R5Dkk1FH or Rspo2 resulted in a significant increase of liver weight (FIG. 40C) and liver to body weight ratio (FIG. 40E) in mice undergoing a continuous exposure to TAA. Treatment with a combination of 18R5Dkk1FH and Rspo2 resulted in a further increase in liver weight and liver to body weight ratio beyond that observed with either treatment alone. The combination 18R5Dkk1FH and Rspo2 treatment resulted in a decrease of the fibrosis marker Col1a1 mRNA expression (FIG. 40G). Histological liver sections were stained with Sirius red to visualize the accumulation of collagen in fibrotic area (FIG. 40H). Quantification of the percentage of red are, using Image J analysis software, showed a significant increase of fibrotic area in TAA-treated mice. A combination of 18R5Dkk1FH and Rspo2 resulted in a reversal of fibrotic area increase when compared to mice treated with the eGFP negative control. Treatment with Rspo2 alone also resulted in a significant but smaller reversal than the combination treatment.

Figure 40A:
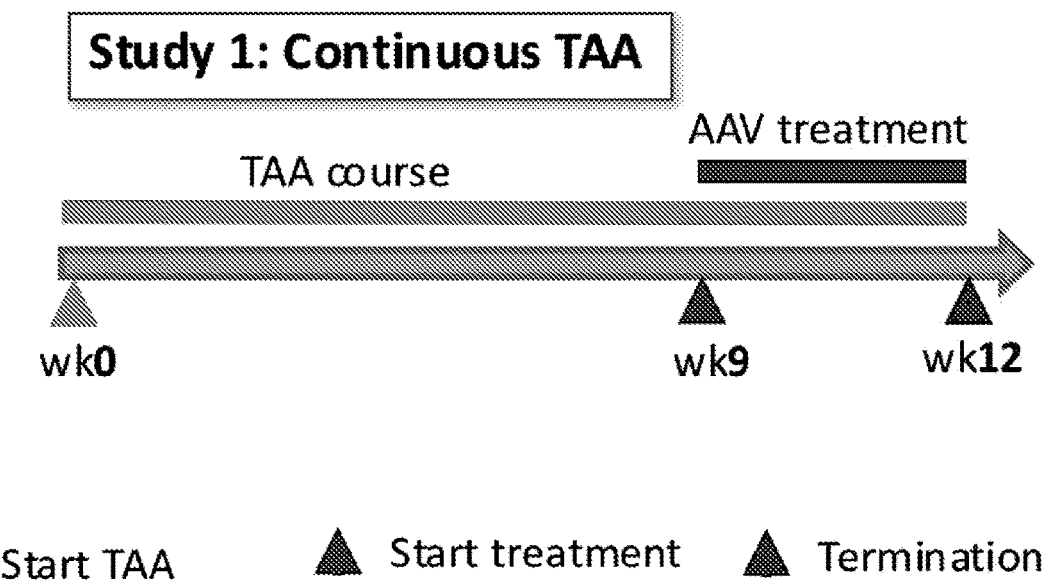
Figure 40B:
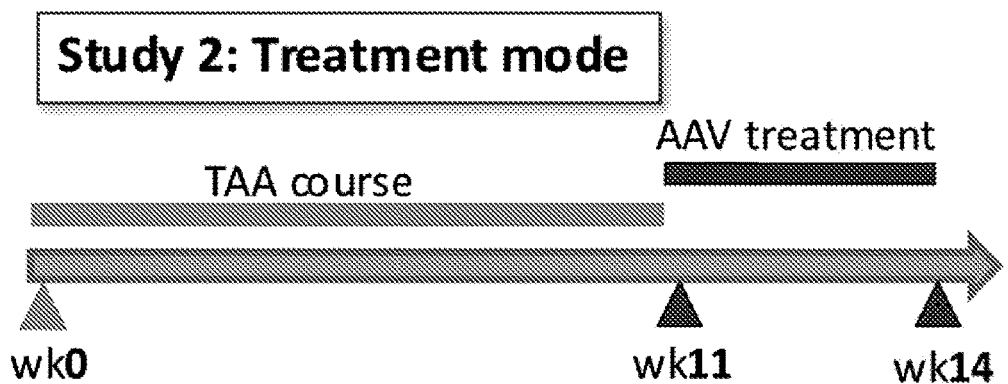

In Study 2, (FIGS. 40B, 40D, 40F), mice were exposed to TAA-supplemented water for 11 weeks, and were returned to standard drinking thereafter, two days prior to AAV treatment. At the start of AAV treatment, mice exposed to TAA (n=10) or not (n=5) were weighed and sacrificed to collect liver samples for baseline measurements. The remaining mice were injected with AAV vectors that expressed an enhanced green fluorescent protein (eGFP) (1.3e11 genomic particles (GC)), 18R5-DKK1c-FlagHis (3e10 or 1e11 GC) or Rspo2 protein (1e11 GC) or a combination of 18R5-DKK1c-FlagHis (3e10 GC) and Rspo2 (1e11 GC). 5 age-matched naïve animals (no TAA) were kept as a negative control. Three weeks after AAV injection, all mice were weighed and euthanized. Livers were weighed and liver samples were collected for mRNA and histological analysis.

A similar liver weight and liver to body weight increase was observed in mice treated with 18R5-Dkk1c-FlagHis and Rspo2 either alone or in combination than what was observed in Study 1 (FIGS. 40D, 40F).

These studies show that 18R5-Dkk1c-FlagHis and Rspo2 can increase liver weight in a TAA-induced liver cirrhosis model and reduce fibrosis markers. These results suggest that 18R5-Dkk1c-FlagHis and Rspo2 can promote liver tissue repair after chronic liver injury.

Example 25

In Vivo Chronic Liver Injury Models and Characterization of Recombinantly Produced Wnt Surrogates In vivo experiments were conducted in thioacetamide (TAA)-induced and CC14-induced mouse models of liver cirrhosis by treating mice with recombinantly produced anti-eGFP, R2M3-26 and Rspo2 proteins.

In the TAA-induced cirrhosis model, six weeks old male mice were exposed to TAA-supplemented drinking water (300 mg/L) for approximately 22 weeks (FIG. 41A). TAA exposure was removed two days prior to beginning of treatment with recombinant proteins and mice were provided with fresh drinking water. Mice were housed 5 per cage and n=10 per treatment group were used. In a mono treatment study (FIGS. 41B, 41D, 41F, 41H, 41J, 41L), mice were injected i.p. with anti-eGFP (1 mg/kg) or Rspo2 (1 mg/kg) twice weekly. In a combination treatment study (FIGS. 41C, 41E, 41G, 41I, 41K, 41M), mice were injected i.p. with anti-eGFP (1.3 mg/kg) or a combination of R2M3-26 (0.3 mg/kg) and Rspo2 (1 mg/kg) twice weekly. Mice were then weighed and sacrificed at day 3, 7 or 14 days after beginning of treatment. Groups of control mice without exposure to TAA (n=5 per group) were euthanized at day 0 and day 14 in both studies.

Treatment with Rspo2 protein alone or in combination with R2M3-26 resulted in an increase in liver to body weight ratio (FIGS. 41B and 41C) and a transient stimulation of the Wnt signaling pathway as shown by an increase in Axin2 expression (FIGS. 41D and 41E). Treatment with Rspo2 protein alone or in combination with R2M3-26 induced the following proliferation markers: cyclinD1 (FIGS. 41F, 41G) and Ki67 (FIGS. 41H and 41I) mRNA expression, PCNA (FIGS. 41J, 41K) and pH3 (FIGS. 41L, 41M) positive nuclei.

Figure 41N:
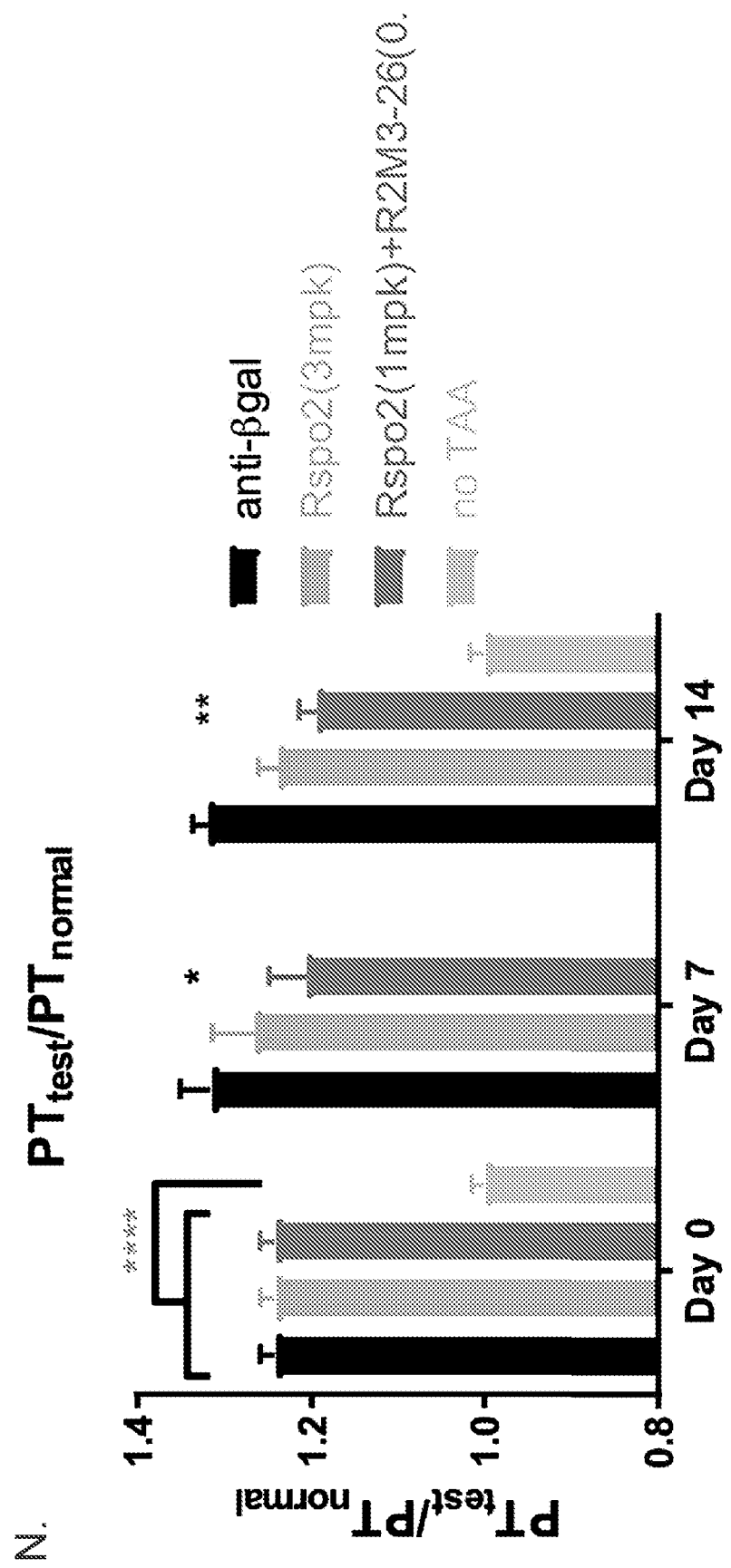

In an additional study, plasma was collected for prothrombin time measurement. Coagulation time is impaired in TAA-induced cirrhosis model as exemplified by an increase in pro-thrombin (PT) test to normal value ratio in mice exposed to TAA when compared to normal mice without TAA exposure (FIG. 41N). Treatment with Rspo2 (1 mg/kg)

and R2M3-26 (0.3 mg/kg) reversed the prolongation in PT time as shown by the decrease in $PT_{test}/PT_{normal}$ ratio at day 7 and day 14 after biweekly Rspo2 and R2M3-26 treatment.

These studies show that Rspo2 and R2M3-26 can stimulate liver cell proliferation and improve hepatocytes functional activity such as pro-thrombin time in a TAA-induced liver cirrhosis model. These results suggest that Rspo2 and R2M3-26 can promote liver tissue repair in chronic liver disease.

In the CC14-induced cirrhosis model, six-weeks old C57BL/6J male mice were injected i.p. with 2 ml/kg CC14 in mineral oil, twice weekly for 8 weeks (FIG. 42A). 3 days after the last CC14 injection, mice were injected i.p. twice weekly with the following recombinant proteins: anti-β-galactosidase (10 mg/kg), Rspo2 (1 or 10 mg/kg), or a combination of R2M3-26 (0.3 mg/kg) and Rspo2 (1 mg/kg). Three additional control groups were included: one group injected with CC14 but no proteins, one group injected with mineral oil, and one untreated age-matched naïve group. n=8 were used for each group. After two weeks of treatment with recombinant proteins, mice were weighed and sacrificed. Plasma was collected for pro-thrombin time measurement. Livers were weighed and liver samples were collected for histological analysis.

Treatment with R2M3-26 and Rspo2 resulted in a significant increase in liver to body weight ratio when compared to treatment with anti-β-galactosidase negative control (FIG. 42B). Treatment with Rspo2 (10 mg/kg) or a combination of R2M3-26 and Rspo2 resulted in a significant decrease in prothrombin time (FIG. 42C). Treatment with Rspo2 (10 mg/kg) or a combination of R2M3-26 and Rspo2 resulted in a significant reversal in fibrotic area, induced by CC14 (FIG. 42D).

This study showed that Rspo2 and R2M3-26 can induce an increase in liver weight, improve hepatocytes functional activity such as pro-thrombin time and reduce fibrosis markers in a CC14-induced liver cirrhosis model. These results suggest that Rspo2 and R2M3-26 can promote liver tissue repair in chronic liver disease.

Example 26

In Vivo Acute Liver Injury Model and Characterization of Recombinantly Produced Wnt Surrogates In vivo experiments were conducted using acetaminophen-induced mouse models of acute liver injury by treating mice with recombinantly produced anti-eGFP, R2M3-26 and Rspo2 proteins.

Eight-week old C57BL/6 male mice were housed 5 per cage. n=10 were used per group. Mice were fasted overnight for 12 hours. Acetaminophen (APAP) was administered i.p. at a sublethal dose (300 mg/kg).

Figure 43:
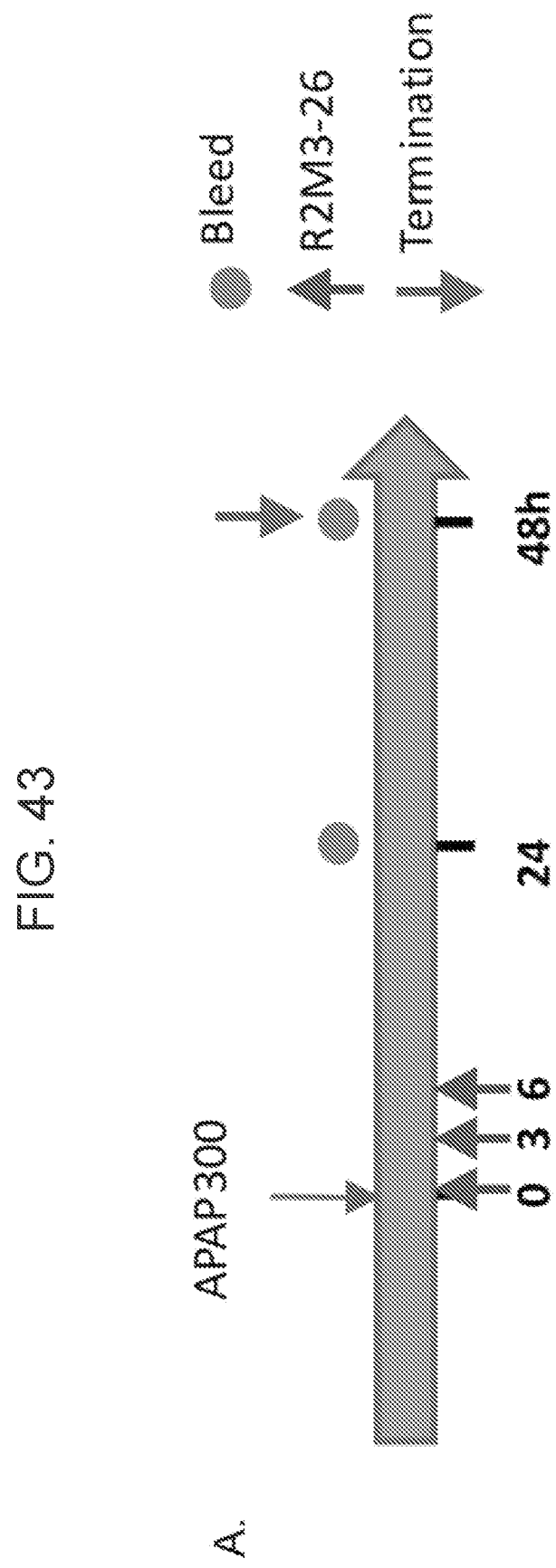

In a first study, anti-eGFP (0.3 mpk) or R2M3-26 (0.3 mpk) were injected i.p. either immediately after or 3 or 6 hours after APAP injection (FIG. 43). Serum samples were collected at 24 and 48 hours after APAP injection for ALT measurements. Mice were sacrificed 48 hours after APAP injection and liver samples were collected for mRNA analysis.

R2M3-26 treatment did not affect ALT level significantly (FIG. 43B). Treatment with R2M3-26 induced cyclinD1 (FIG. 43C) and Ki67 (FIG. 43D) mRNA significantly, beyond the level induced by APAP treatment alone.

Figure 44:
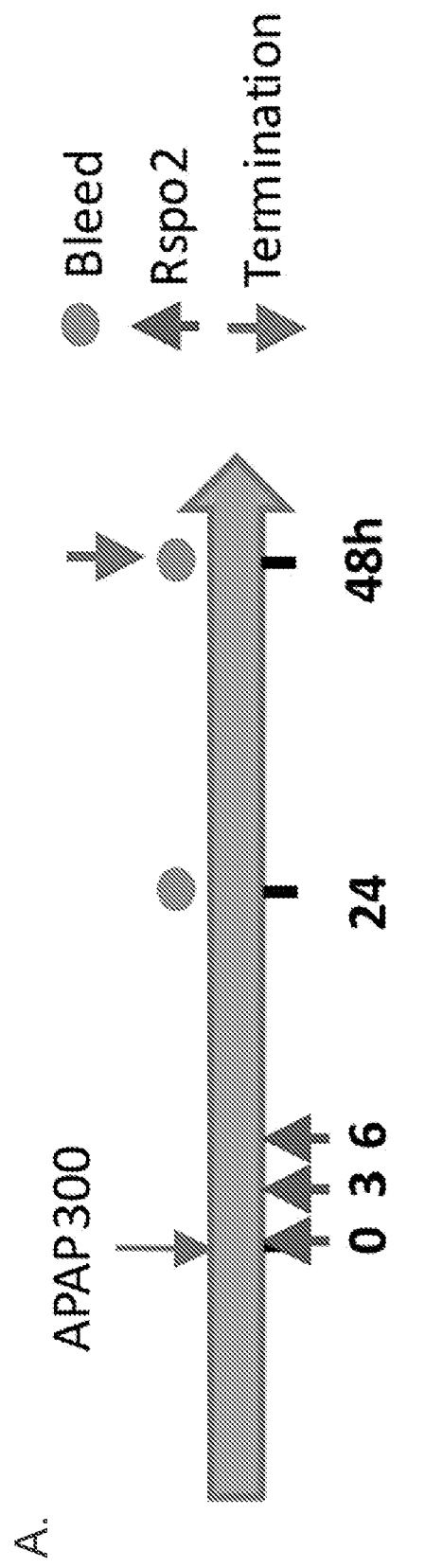

In a second study, human Fc (0.46 mg/kg) or Rspo2 (0.46 mg/kg) were injected i.p. either immediately after or 3 or 6 hours after APAP injection (FIG. 44). Serum samples were collected at 24 and 48 hours after APAP injection. Liver samples were collected at 48 hours after APAP injection. Rspo2 treatment did not affect ALT serum level significantly (FIG. 44B). Treatment with Rspo2 induced cyclinD1 (FIG. 44C) and Ki67 (FIG. 43D) mRNA significantly, beyond the level induced by APAP treatment alone.

Figure 45:
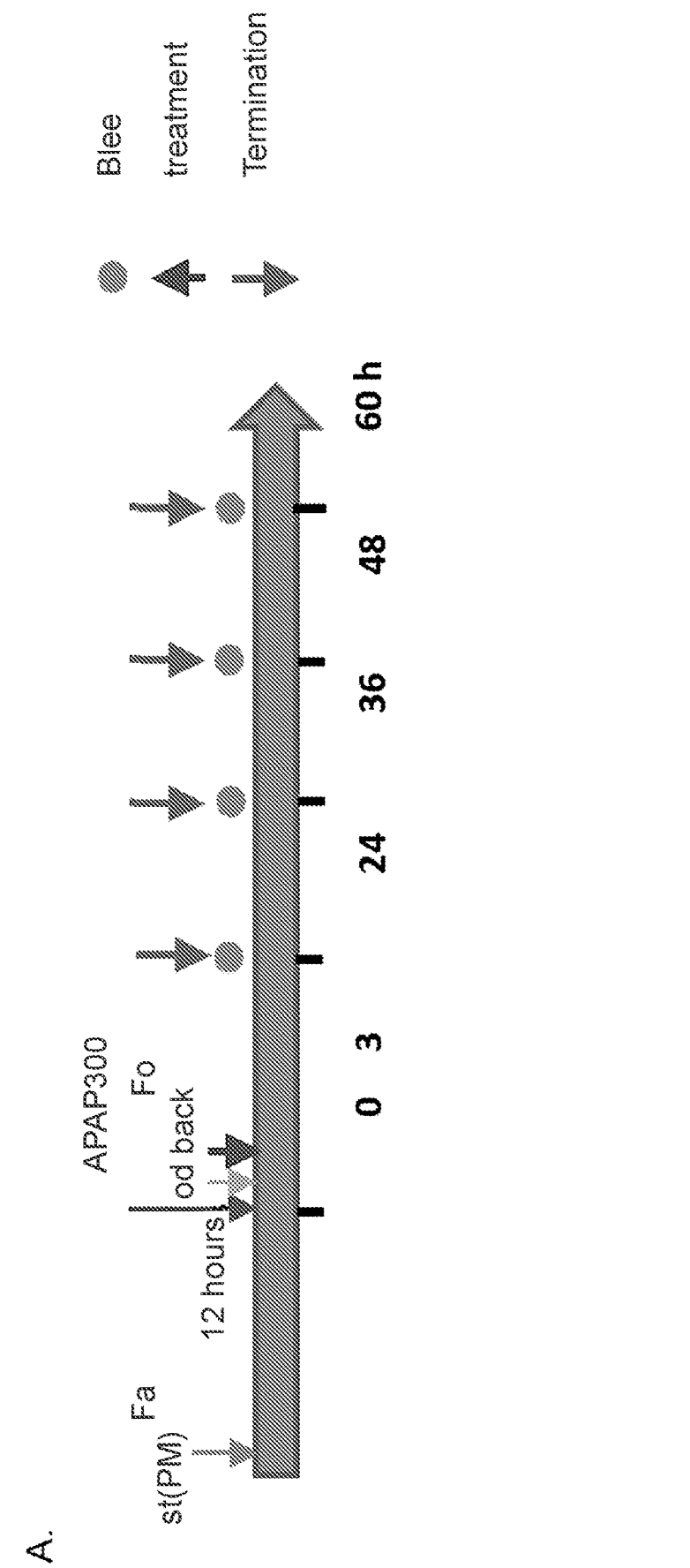

In a third study, anti-eGFP (0.56 mg/kg) or a combination of R2M3-26 (0.1 mg/kg) and Rspo2 (0.46 mg/kg) were injected i.p. 3 hours after APAP administration. Serum and liver samples were collected at 24, 36, 48 and 60 hours after APAP injection for ALT measurements and mRNA analysis. R2M3-26 and Rspo2 combination treatment did not affect ALT level significantly (FIG. 45B). Treatment with R2M3-26 and Rspo2 induced cyclinD1 (FIG. 45C) and Ki67 (FIG. 45D) mRNA significantly, beyond the level induced by APAP treatment alone.

Figure 46:
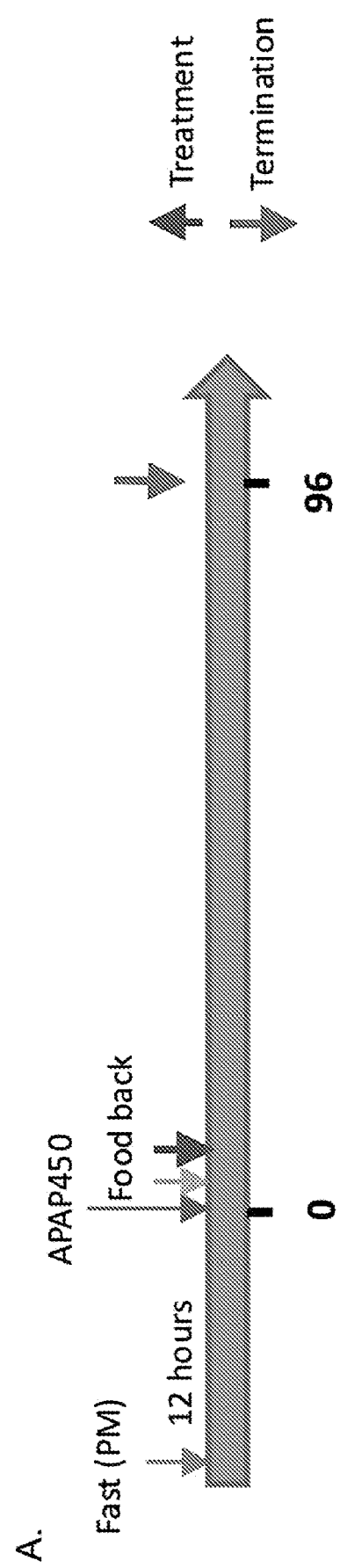

An additional study was performed to evaluate the effect of Rspo2 and R2M3-26 on the survival of mice treated with a dose of 600 mg/kg of acetaminophen (FIG. 46). Anti-eGFP (0.3 mg/kg), R2M3-26 (0.3 mg/kg), Rspo2 (0.46 mg/kg) or a combination of R2M3-26 (0.1 mg/kg) and Rspo2 (0.46 mg/kg) were injected i.p. 3 hours after APAP administration. Mice were monitored several times daily over the next 96 hours. A consistent trend in improving survival was observed in groups treated with R2M3-26 (FIG. 46B), Rspo2 (FIG. 46C) or a combination of R2M3-26 and Rspo2 (FIG. 46D).

These studies show that Rspo2 and R2M3-26 can induce proliferation markers beyond that induced spontaneously in APAP-induced acute injury model. These results suggest that Rspo2 and R2M3-26 can enhance liver tissue repair after an acute liver injury.

The various embodiments described above can be combined to provide further embodiments. All of the U.S. patents, U.S. patent application publications, U.S. patent applications, foreign patents, foreign patent applications and non-patent publications referred to in this specification and/or listed in the Application Data Sheet are incorporated herein by reference, in their entirety. Aspects of the embodiments can be modified, if necessary to employ concepts of the various patents, applications and publications to provide yet further embodiments. These and other changes can be made to the embodiments in light of the above-detailed description.

In general, in the following claims, the terms used should not be construed to limit the claims to the specific embodiments disclosed in the specification and the claims, but should be construed to include all possible embodiments along with the full scope of equivalents to which such claims are entitled. Accordingly, the claims are not limited by the disclosure.

SEQUENCE LISTING (2267 sequences)

SEQ ID NO: 1 - protein, 227 aa, Artificial Sequence
  Made in Lab - Synthesized variable heavy chain sequence
QLQLQESGSGLVKPSQTLSLTCAVSGGSISSGGYSWSWIRQPPGKGLEWIGSIYHSGSTYYNPSLKSRLTISVDTSKNQFSLKLSSVTAADTAVYYCARFYYDILTGYSYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 2 - protein, 223 aa, Artificial Sequence
  Made in Lab - Synthesized variable heavy chain sequence
QVQLQESGPGLVKPSETLSLTCTVSGGSISGNNYYWGWIRQPPGKGLEWIGSIYFTGGTYYNPSLKSRVTISVDTSKNQFSLKLSSVTAADTAVYYCARVMLITDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3 - protein, 224 aa, Artificial Sequence
  Made in Lab - Synthesized variable heavy chain sequence
QVQLQESGPGLVKPSETLSLTCTVSGGAISGTSYFWGWIRQPPGKGLEWIGSIYYTGNTYYNPSLKSRLTVSVDTSKNQFSLNLNSVTAADTATYYCARIGIAVAAPVDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4 - protein, 223 aa, Artificial Sequence
  Made in Lab - Synthesized variable heavy chain sequence
QVQLQESGPGLVKPSETLSLTCTVSGGSISSSSYYWGWIRQHPGKGLEWIGYIYYSGSTYYNPSLKSRVTISVDTSKNQFSLKLNSVTAADTAVYYCARATYGGDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5 - protein, 230 aa, Artificial Sequence
  Made in Lab - Synthesized variable heavy chain sequence
QLQLQESGPGLVKPSQTLSLTCTVSGGSISSGGYYWSWIRQHPGKGLEWIGYIYYSGSTYYNPSLKSRVTISVDKSKNQFSLKLSSVTAADTAVYYCARVRDYYDSSGYYYDYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 6 - protein, 227 aa, Artificial Sequence
  Made in Lab - Synthesized variable heavy chain sequence
QVQLQQWGAGLLKPSETLSLTCAVSGASFSGHYWTWIRQPPGKGLEWIGEIDHTGSTNYEPSLRSRVTISVDTSKNQFSLNLKSVTAADTAVYYCARGGQGGYDWGHYHGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7 - protein, 225 aa, Artificial Sequence
  Made in Lab - Synthesized variable heavy chain sequence
EVQLLQSGAEVKKPGSSVKVSCKASGGTFTYRYLHWVRQAPGQGLEWMGGIIPIFGTGNYAQKFQGRVTITADESTSTAYMELSSLRSEDTAVYYCASSMVRVPYYYGMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8 - protein, 122 aa, Artificial Sequence
  Made in Lab - Synthesized variable heavy chain sequence
EVQLVESGGGLVQAGGSLRLSCTASGSTFSNYAMGWFRQAPGKEREFVAAISWGGGSTFYSGSVKGRFTISRDSAKNTVHLQMDSLIPEDTAVYYCAAGPIARWYRGDMDYWGKGTLVTVSS

SEQ ID NO: 9 - protein, 122 aa, Artificial Sequence
  Made in Lab - Synthesized variable heavy chain sequence
DVQLVESGGGLVQTGGSLRLSCVASGRTFRAYAMGWFRQAPGKEREFVSAISWSGGSTYYAGSVKGRFTISRDSAKNTVHLQMDSLIPEDTAVYYCAAGPIARWYRGDMDYWGKGTLVTVSS

SEQ ID NO: 10 - protein, 122 aa, Artificial Sequence
  Made in Lab - Synthesized variable heavy chain sequence
QVQLVESGGGLVQPGGSLRLSCAASGFTFREYAMTWVRQSPGKRLEWVSGISRDGGRTSYSDSLKGRFTISRDNAKNTLYLQMNNLTPEDTAVYYCAPRVLVTAPSGGMDYWGKGTQVTVSS

SEQ ID NO: 11 - protein, 122 aa, Artificial Sequence
  Made in Lab - Synthesized variable heavy chain sequence
AVQLVDSGGGLMQAGGSLRLSCAASGRTFGTWAMGWFRQAPGKEREFVAAISYNGFSTYYSDAVKGRFTISRDNAKNTMYLQMDSLIPEDTAVYYCAAGPIARWYRGDMDYWGKGTQVTVSS

SEQ ID NO: 12 - protein, 122 aa, Artificial Sequence
  Made in Lab - Synthesized variable heavy chain sequence
AVQLVESGGGLVQAGGPLRLSCAASGRTSSSYAMGWFRQAPGKEREFVAAISWSGGSTYYADSVKGRFTISRDNAKNTVYLQMDSPIPEDTAVYYCAAGPIARWYRGDMDYWGKGTLVTVSS

SEQ ID NO: 13 - protein, 122 aa, Artificial Sequence
  Made in Lab - Synthesized variable heavy chain sequence
AVQLVESGGGLVQAGGSLRLSCTASGRTFSSYAMGWFRQAPGKEREFVAAISWSGRSTYYADSVKGRFTISRDNAKNTVYLQMNSLKSEDTAAYYCAAGPIARWYRGDMDYWGKGTLVTVSS

SEQ ID NO: 14 - protein, 124 aa, Artificial Sequence
  Made in Lab - Synthesized variable heavy chain sequence
DVQLVESGGGLVQAGGSLRLSCAASGRTFSSYAMGWFRQAPGKEREFVAAISWSGGSTYYADSVKGRFTISRDNAKNTVYLQMNSLKPEDTAVYYCAAGPNYSWFMPSSSRLIWGQGTLVTVSS

SEQ ID NO: 15 - protein, 124 aa, Artificial Sequence
  Made in Lab - Synthesized variable heavy chain sequence
QVKLEESGGGLVQAGGSLRLSCAASGGTSSTYAMGWFRQAPGKEREFVAAINRSGGSTYYADSVKGRFTISRDNAKNTVYLQMNSLNPEDTAVYYCAAVFLSRNYEIQEYYRYQGQGTQVTVSS

SEQ ID NO: 16 - protein, 224 aa, Artificial Sequence
  Made in Lab - Synthesized variable heavy chain sequence
QVQLVQSGAEVKKPGASVKVSCKASGGTFSSYAISWVRQAPGQGLEWMGWISTYNGATNYARKFQGRVTMTRDTSTSTVYMELSSLRSEDTAVYYCARGGAGRFGEGMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 17 - protein, 225 aa, Artificial Sequence
  Made in Lab - Synthesized variable heavy chain sequence
EVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCASSKEKATYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 18 - protein, 232 aa, Artificial Sequence
  Made in Lab - Synthesized variable heavy chain sequence
QVQLVQSGAEVKKPGSSVKVSCKASGYTFTNNFMHWVRQAPGQGLEWMGWINPNSGGTKYAQKFQGRVTITADESTSTAYMELSSLRSEDTAVYYCARSVGEVGATMLGIGVWYWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 19 - protein, 221 aa, Artificial Sequence
  Made in Lab - Synthesized variable heavy chain sequence
EVQLVESGGGLVKPGGSLRLSCAASGFNFGIYSMTWVRQAPGKGLEWISYISGDSGYTNYADSVKGRFTISRDDSKNTLYLQMNSLKTEDTAVYYCARVGPGGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 20 - protein, 226 aa, Artificial Sequence
  Made in Lab - Synthesized variable heavy chain sequence
QVQLVQSGAEVKKPGASVKVSCKASGYTFTNNFMHWVRQAPGQGLEWMGRINPNSGGTNYAQKFQGRVTMTRDTSTSTVYMELSSLRSEDTAVYYCASQNYYGSGSYPGFDYWGQGTLVNVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 21 - protein, 223 aa, Artificial Sequence
  Made in Lab - Synthesized variable heavy chain sequence
QVQLVQSGAEVKKPGSSVKVSCKASGYTFTYRYLHWVRQAPGQGLEWMGGIIPIFGTANYAQKFQGRVTITADESTSTAYMELSSLRSEDTAVYYCATHDSSGYYSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 22 - protein, 221 aa, Artificial Sequence
  Made in Lab - Synthesized variable heavy chain sequence
QVQLVQSGAEVKKPGASVKVSCKASGYTFTNNFMHWVRQAPGQGLEWMGGFDPEDGETIYAQKFQGRVTMTRDTSTSTVYMELSSLRSEDTAVYYCARVGRGYSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 23 - protein, 218 aa, Artificial Sequence
  Made in Lab - Synthesized variable heavy chain sequence
EVQLVESGGGLVQPGGSLRLSCAASGFTFSDHYMSWVRQAPGKGLEWVALVGYDGSQQFYGESVKGRFTISRDNSKNTLYLQMNSLRAEDTAVYYCNTGIPMLYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 24 - protein, 223 aa, Artificial Sequence
  Made in Lab - Synthesized variable heavy chain sequence
QVQLVQSGAEVKKPGSSVKVSCKASGGTFSSYAISWVRQAPGQGLEWMGRIIPILGIANYAQKFQGRVTITADESTSTAYMELSSLRSEDTAVYYCARESVNNYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 25 - protein, 228 aa, Artificial Sequence
  Made in Lab - Synthesized variable heavy chain sequence
QVQLVQSGAEVKKPGASVKVSCKASGYTFTNNFMHWVRQAPGQGLEWMGRINPNSGGTNYAQKFQGRVTMTRDTSTSTVYMELSSLRSEDTAVYYCARGQGYSSGWYRGDAFDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 26 - protein, 227 aa, Artificial Sequence
  Made in Lab - Synthesized variable heavy chain sequence
QVQLVQSGAEVKKPGASVKVSCKASGFTFTSSAVQWVRQAPGQGLEWMGWMNPNSGNTGYAQKFQGRVTMTRDTSTSTVYMELSSLRSEDTAVYYCARGRGQQWLTGYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 27 - protein, 225 aa, Artificial Sequence
  Made in Lab - Synthesized variable heavy chain sequence
EVQLVESGGGLVQPGGSLRLSCAASGFAFSSHWMHWVRQAPGKGLEWVSAIDGSGGSTYYADSVKGRFTISRDNSKNTLYLQMNSLRAEDTAVYYCARDRQLGWAHWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 28 - protein, 227 aa, Artificial Sequence
  Made in Lab - Synthesized variable heavy chain sequence
EVQLVQSGGGLVQPGGSLRLSCAASGFNLRRYNMNWVRQAPGKGLEWVSRISNSGSLVYYADSVKGRFTISRDNSKNTLYLQMNSLRAEDTAVYYCARDADSSGYYRYDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 29 - protein, 221 aa, Artificial Sequence
  Made in Lab - Synthesized variable heavy chain sequence
QVQLVQSGAEVKKPGSSVKVSCKASGGAFSTSSISWVRQAPGQGLEWVGRIIPVLGTANYAQKFQGRVTITADESTSTAYMELSSLRSEDTAVYYCAKGGWRSSFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 30 - protein, 223 aa, Artificial Sequence
  Made in Lab - Synthesized variable heavy chain sequence
QVQLVQSGAEVKKPGASVKVSCKASGYTFTSYDINWVRQAPGQGLEWMGGFDPEDGETIYAQKFQGRVTMTRDTSTSTVYMELSSLRSEDTAVYYCAKAGDWGLYGMDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 31 - protein, 230 aa, Artificial Sequence
  Made in Lab - Synthesized variable heavy chain sequence
QVQLVQSGAEVKKPGASVKVSCKASGYTFTNNFMHWVRQAPGQGLEWMGWINPNSGDTKFAPKFQGRVTMTRDTSTSTVYMELSSLRSEDTAVYYCAREANYDILTGYIRPDAFDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 32 - protein, 224 aa, Artificial Sequence
  Made in Lab - Synthesized variable heavy chain sequence
QVQLVQSGAEVKKPGASVKVSCKASGYTFTSYYMNWVRQAPGQGLEWMGIISPSGGSTSYAQKFQGRVTMTRDTSTSTVYMELSSLRSEDTAVYYCARWGDYGDLYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 33 - protein, 228 aa, Artificial Sequence
  Made in Lab - Synthesized variable heavy chain sequence
QVQLVQSGAEVKKPGASVKVSCKASGYIFTDYYMHWVRQAPGQGLEWMGWMNPNSGNTGYAQKFQGRVTMTRDTSTSTVYMELSSLRSEDTAVYYCARGGSRYDFWSGHWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 34 - protein, 227 aa, Artificial Sequence
  Made in Lab - Synthesized variable heavy chain sequence
EVQLVQSGGGLVKPGGSLRLSCAASGFTFSSYSMNWVRQAPGKGLEWVSYIENDGSITTYADSVKGRFTISRDDSKNTLYLQMNSLKTEDTAVYYCARAPYYYGSGSLFRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 35 - protein, 219 aa, Artificial Sequence
  Made in Lab - Synthesized variable heavy chain sequence
EVQLVESGGGLVKPGGSLRLSCAASGFTFSSYAMHWVRQAPGKGLEWVSAIGAGGGTYYADSVKGRFTISRDDSKNTLYLQMNSLKTEDTAVYYCARDAYNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 36 - protein, 222 aa, Artificial Sequence
  Made in Lab - Synthesized variable heavy chain sequence
EVQLVESGGGLVKPGGSLRLSCAASGFTFSNAQMSWVRQAPGKGLEWVSAIGTGGGTYYADSVKGRFTISRDDSKNTLYLQMNSLKTEDTAVYYCAREGSYYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 37 - protein, 116 aa, Artificial Sequence
  Made in Lab - Synthesized variable heavy chain sequence
AVQQVESGGGLVQPGGSLRLSCAASGFTLDYYAISWFRQAPGKKRELVADITSGGSTNYADSVKGRFTISRDNAKNTIYLQMNSLKPEDTAVYFCNAVTYNGYTIWGQGTQVTVSS

SEQ ID NO: 38 - protein, 220 aa, Artificial Sequence
  Made in Lab - Synthesized variable light chain sequence
DIVMTHTPLSLSVTPGEPASISCRSSRSLLDTDDGNTYLDWYLQKPGQSPQLLIHTLSHRASGVPDRFSGSGSGTDFTLKISRVEAEDVGVYYCMQSIQLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 39 - protein, 219 aa, Artificial Sequence
  Made in Lab - Synthesized variable light chain sequence
DVVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGTHWPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 40 - protein, 214 aa, Artificial Sequence
  Made in Lab - Synthesized variable light chain sequence
EIVLTQSPATLSLSPGEGATLSCRASQSVGTYLTWYRQKPGQAPRLLIYDASNRATGIPARFSGSGAGTDFTLKISRVEAEDVGVYYCMQATQFPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 41 - protein, 217 aa, Artificial Sequence
  Made in Lab - Synthesized variable light chain sequence
QSVVTQPPSVSGAPGQRVTISCTRSSSNIGAGYDVHWYQQHPGTAPKLLIFGNSIRPSGVPDRFSGSKSGTSATLGITGLQTGDEADYYCGTWDSSLSAWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 42 - protein, 214 aa, Artificial Sequence
  Made in Lab - Synthesized variable light chain sequence
DIQLTQSPSSLSASVGDRVTITCRASRSISSYFNWYQQKPGKAPKLLIYAASSLQSGVPSRFSGSRSGTDFTLTISSLQPEDFATYYCQQADTFPPTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 43 - protein, 213 aa, Artificial Sequence
  Made in Lab - Synthesized variable light chain sequence
SYVLTQPPSVSVSPGQTASITCSGDKVGHKYASWYQQKPGQSPVLVIYEDSQRPSGIPVRFSGSNSGNTATLTISGTQAMDEADYYCQAWDSSTDVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 44 - protein, 214 aa, Artificial Sequence
  Made in Lab - Synthesized variable light chain sequence
DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 45 - protein, 214 aa, Artificial Sequence; identical to SEQ ID NO: 44
  Made in Lab - Synthesized variable light chain sequence

SEQ ID NO: 46 - protein, 216 aa, Artificial Sequence
  Made in Lab - Synthesized variable light chain sequence
QAVVLQEPSLSVSPGGTVTLTCGLSSGSVSTNYYPSWYQQTPGQAPRTLIYYTNTRSSDVPERFSGSIVGNKAALTITGAQPDDESVYFCLLYLGRGIWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 47 - protein, 214 aa, Artificial Sequence
  Made in Lab - Synthesized variable light chain sequence
DIQMTQSPSSLSASVGDRVTITCRASQSISSYLNWYQQKPGKAPKLLIYAASSLQSGVPSRFSGSGSGTDFTLTISSLQPEDFATYYCQQSYRTPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 48 - protein, 214 aa, Artificial Sequence
  Made in Lab - Synthesized variable light chain sequence
DIQMTQSPSSLSASVGDRVTITCRASQGISSYLAWYQQKPGKAPKLLIYAASNLLGGVPSRFSGSGSGTDFTLTISSLQPEDFATYYCQQTYSTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 49 - protein, 214 aa, Artificial Sequence; identical to SEQ ID NO: 44
  Made in Lab - Synthesized variable light chain sequence

SEQ ID NO: 50 - protein, 214 aa, Artificial Sequence; identical to SEQ ID NO: 44
  Made in Lab - Synthesized variable light chain sequence

SEQ ID NO: 51 - protein, 214 aa, Artificial Sequence; identical to SEQ ID NO: 44
  Made in Lab - Synthesized variable light chain sequence

SEQ ID NO: 52 - protein, 214 aa, Artificial Sequence; identical to SEQ ID NO: 44
  Made in Lab - Synthesized variable light chain sequence

SEQ ID NO: 53 - protein, 214 aa, Artificial Sequence; identical to SEQ ID NO: 44
  Made in Lab - Synthesized variable light chain sequence

SEQ ID NO: 54 - protein, 214 aa, Artificial Sequence; identical to SEQ ID NO: 44
  Made in Lab - Synthesized variable light chain sequence

SEQ ID NO: 55 - protein, 214 aa, Artificial Sequence
  Made in Lab - Synthesized variable light chain sequence
DIQMTQSPSSLSASVGDRVTITCRASQGISSALAWYQQKPGKAPKLLIYGASTLQSGVPSRFSGSGSGTDFTLTISSLQPEDFATYYCLQDYNYPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 56 - protein, 214 aa, Artificial Sequence; identical to SEQ ID NO: 44
  Made in Lab - Synthesized variable light chain sequence

SEQ ID NO: 57 - protein, 214 aa, Artificial Sequence
  Made in Lab - Synthesized variable light chain sequence
EIVLTQSPATLSVSPGERATLSCRASQSVSSNLAWYQQKPGQAPRLLIYDASNRATGIPARFSGSGSGTEFTLTISSLQSEDFAVYYCQQRNNWLYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 58 - protein, 214 aa, Artificial Sequence
  Made in Lab - Synthesized variable light chain sequence
EIVLTQSPATLSVSPGERATLSCRASQSVSSNLAWYQQKPGQAPRLLIYGASTRATGIPARFSGSGSGTEFTLTISSLQSEDFAVYYCQQYNSWPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 59 - protein, 214 aa, Artificial Sequence
  Made in Lab - Synthesized variable light chain sequence
DIQMTQSPSSLSASVGDRVTITCRASQSISRWLAWYQQKPGKAPKLLIYAASSLQSGVPSRFSGSGSGTDFTLTISSLQPEDFATYYCQQTNTFPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 60 - protein, 214 aa, Artificial Sequence
  Made in Lab - Synthesized variable light chain sequence
EIVLTQSPATLSVSPGERATLSCRASQSLRSKLAWYQQKPGQAPRLLIYGASTRATGIPARFSGSGSGTEFTLTISSLQSEDFAVYYCQQYANSPWTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61 - protein, 214 aa, Artificial Sequence
  Made in Lab - Synthesized variable light chain sequence
DIQMTQSPSSLSASVGDRVTITCRASQGISSALAWYQQKPGKAPKLLIYATSTLQSGVPSRFSGSGSGTDFTLTISSLQPEDFATYYCQQVNSYPPTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 62 - protein, 214 aa, Artificial Sequence
  Made in Lab - Synthesized variable light chain sequence
DIQMTQSPSSLSASVGDRVTITCRASQGISNYLAWYQQKPGKAPKLLIYAASSLQSGVPSRFSGSGSGTDFTLTISSLQPEDFATYYCQQSYSTPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 63 - protein, 214 aa, Artificial Sequence; identical to SEQ ID NO: 44
  Made in Lab - Synthesized variable light chain sequence

SEQ ID NO: 64 - protein, 214 aa, Artificial Sequence; identical to SEQ ID NO: 44
  Made in Lab - Synthesized variable light chain sequence

SEQ ID NO: 65 - protein, 216 aa, Artificial Sequence
  Made in Lab - Synthesized variable light chain sequence
EIVLTQSPATLSVSPGERATLSCRASQNIGSRLAWYQQKPGQAPRLLIYGASNRASGIPARFSGSGSGTEFTLTISSLQSEDFAVYYCQQYNHWPPLFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 66 - protein, 124 aa, Artificial Sequence
  Made in lab - synthesized variable heavy chain
QVQLVESGGGLVQAGGSLRLSCAASGRTFSSYAMSWFRQAPGKEREFVAVIGRSGGIKYYADSVKGRFTISRDNTINTVYLQMNNLTPEDTAIYYCATRRPFNSYNTEQSYDSWGRGTLVTVSS

SEQ ID NO: 67 - protein, 121 aa, Artificial Sequence
  Made in lab - synthesized variable heavy chain
AVQLVESGGGLVQAGGSLRLSCGVSGSIFSIYAMGWYRQAPGKERELVAVITSGGKTVYADSVKGRFTITEDAAKNTVYLQMNSLKAEDTAVYYCYADSRSSWYDEYLEHWGRGTLVTVSS

SEQ ID NO: 68 - protein, 119 aa, Artificial Sequence
  Made in lab - synthesized variable heavy chain
QVQLVESGGGLVQAGDSLRLSCVVSGRTFSVYGVGWFRQAPGKEREVVAAVSASGGYTWYADSVKGRFTISRDNAKSTAFLQMNSLQPEDTAVYYCKAAPRWGGATAYWGQGTQVTVSS

SEQ ID NO: 69 - protein, 119 aa, Artificial Sequence
  Made in lab - synthesized variable heavy chain
DVQLVESGGGLVQPGGSLRLSCAAPGSIFSDGAMGWYRQAPGKQRELVAVISGGRTGYADFVKGRFTISRDNGKNTVNLQMNRLEPEDTAVYFCNTYPFPIYKKGYPFWGQGTQVTVSS

SEQ ID NO: 70 - protein, 124 aa, Artificial Sequence
  Made in lab - synthesized variable heavy chain
DVQLVESGGGLVQAGGSLRLSCAASGRTFSSYAMSWFRQAPGKEREFVAVIGRSGGIKYYADSVKGRFTISRDNTINTVYLQMNNLTPEDTAIYYCATRRPFNSYNTEQSYDSWGRGTLVTVSS

SEQ ID NO: 71 - protein, 121 aa, Artificial Sequence
  Made in lab - synthesized variable heavy chain
DVQLVESGGGLVQAGESLRLSCAASGSIFSINTMGWYRQAPGKERELVAVITSGGKTVYADSVKGRFTITEDAAKNTVYLQMNSLKAEDTAVYYCYADSRSSWYDEYLEHWGQGTLVTVSS

SEQ ID NO: 72 - protein, 122 aa, Artificial Sequence
  Made in lab - synthesized variable heavy chain
AVQLVESGGGLVQAGGSLRLSCAASGRTLSAYDMGWFRQAPGKERELVGGIRWSGGTTLYPDSVKGRFTISRDNAKNTVYLQMNSLKPEDSAVYYCYARTVIGGFGAFRAHWGQGTQVTVSS

SEQ ID NO: 73 - protein, 119 aa, Artificial Sequence
  Made in lab - synthesized variable heavy chain
DVQLVESGGGLVQPGGSLRLSCAASGSIFMINTMAWYRQAPGNQRELVATIRPVVSETTYADAVKGRFTISRDNAKNTVYLQMNSLKSEDTAIYYCNAKRPWGTRDEYWGQGTLVTVSS

SEQ ID NO: 74 - protein, 122 aa, Artificial Sequence
  Made in lab - synthesized variable heavy chain
QVKLEESGGGLVQPGGSLRLSCETSATIVSIYRINWYRQAPGKQREWVAGITSSGRTIYADSVKGRFTISRDNAKNTVYLQMNNLKPEDTAVYYCNAASTVTAWPYYGPDYWGKGTLVTVSS

SEQ ID NO: 75 - protein, 119 aa, Artificial Sequence
  Made in lab - synthesized variable heavy chain
DVQLVESGGGLVQAGGSLRLACAGSGRIFAIYDIAWYRHPPGNQRELVAMIRPVVTEIDYADSVKGRFTISRNNAMKTVYLQMNNLKPEDTAVYYCNAKRPWGSRDEYWGQGTQVTVSS

SEQ ID NO: 76 - protein, 124 aa, Artificial Sequence
  Made in lab - synthesized variable heavy chain
AVQLVESGGGVVQAGDSLTLSCTMSGRSLSSFAMGWFRRAPGKEREFVARISRGDGYTDEADSVKGRFTISRDNAKNTVYLQMNNVGPEDTAVYHCAAVQAVIGGTLTTAYDYWGQGTLVTVSS

SEQ ID NO: 77 - protein, 124 aa, Artificial Sequence
  Made in lab - synthesized variable heavy chain
EVQLVESGGGLVQAGGSLRVSCAASGGTFSRYHMGWFRQAPGKEREFVSAITWSGGRTYYADFVKGRFTISRDDARNTVYLQMSSLKPEDTAVYYCALTWAPTPTNRRSDYAYWGQGTQVTVSS

SEQ ID NO: 78 - protein, 119 aa, Artificial Sequence
  Made in lab - synthesized variable heavy chain
EVQLVESGGGLVQAGGSLRLACAGSGRIFAIYDMAWYRQAPGNQRELVATIRPVVSETTYADAVKGRFTISRSNAMKTVYLQMNSLKSEDTAIYYCNAKRPWGTRDEYWGQGTLVTVSS

SEQ ID NO: 79 - protein, 126 aa, Artificial Sequence
  Made in lab - synthesized variable heavy chain
AVQLVDSGGGLVQAGDSLTLSCAASGRTFSDYSMGWFRQAPGKEREFVAGISWIADNRYYADVVKGRFTISRDNAKNTVYLQMNSLKPEDTAVYYCTAGRSRYLYGSSLNGPYDYWGQGTQVTVSS

SEQ ID NO: 80 - protein, 119 aa, Artificial Sequence
  Made in lab - synthesized variable heavy chain
AVQLVESGGGLVQAGGSLRLACAGSGRIFAIYDIAWYRQAPGNQRELVATIRPVVSETTYADAVKGRFTISRSNAMKTVYLQMNSLKSEDTAIYYCNAKRPWGTRDEYWGQGTLVTVSS

SEQ ID NO: 81 - protein, 121 aa, Artificial Sequence
  Made in lab - synthesized variable heavy chain
AVQLVDSGGGLVQAGGSLRLSCAVSGRTFSMYDMGWFRQAPGKEREFVASIRWSSGNTWYADSMKGRFTISRDNAKNTVYLQMNSLKPEDTAVYYCYANIYYTRRAPEEYWGQGTLVTVSS

SEQ ID NO: 82 - protein, 119 aa, Artificial Sequence
  Made in lab - synthesized variable heavy chain
EVQLVESGGGLVQPGGSLRLSCAVSRNIFPIDDMSWYRQAPGKQRELVATVTSGGRINYADSVKGRFTISRDGARRTIDLQMNNLKPEDTAVYYCNVDRTLYGKYKEYWGQGTLVTVSS

SEQ ID NO: 83 - protein, 111 aa, Artificial Sequence
  Made in lab - synthesized variable heavy chain
QVKLEESGGGLVQAGGSLRLSCAASGRIFSIYDMGWFRQAPGKEREFVSGIRWSGGTSYADSVKGRFTISKDNAKNTIYLQMNNLKAEDTAVYYCGSRGYWGQGTLVTVSS

SEQ ID NO: 84 - protein, 119 aa, Artificial Sequence; identical to SEQ ID NO: 80
  Made in lab - synthesized variable heavy chain

SEQ ID NO: 85 - protein, 121 aa, Artificial Sequence; identical to SEQ ID NO: 81
  Made in lab - synthesized variable heavy chain

SEQ ID NO: 86 - protein, 126 aa, Artificial Sequence
  Made in lab - synthesized variable heavy chain
EVQLVESGGGLVQAGGSLRLSCATSGRTFNTYAMGWFRQAPGKEREFVASVSWRYDRTYYTDTVKGRFTISRDNAKNTVYLQMNSLKPEDTAVYFCAADTNWRAGPRVGIDEYAYWGQGTLVTVSS

SEQ ID NO: 87 - protein, 119 aa, Artificial Sequence; identical to SEQ ID NO: 82
  Made in lab - synthesized variable heavy chain

SEQ ID NO: 88 - protein, 111 aa, Artificial Sequence; identical to SEQ ID NO: 83
  Made in lab - synthesized variable heavy chain

SEQ ID NO: 89 - protein, 360 aa, Artificial Sequence
  Made in Lab - synthesized Wnt surrogate molecule
MYRMQLLSCIALSLALVTNSDVQLVESGGGLVQPGGSLRLSCAASGSIFMINTMAWYRQAPGNQRELVATIRPVVSETTYADAVKGRFTISRDNAKNTVYLQMNSLKSEDTAIYYCNAKRPWGTRDEYWGQGTLVTVSSGSGGSQTVVLQEPSLSVSPGGTVTLTCGLSSGSVSTNYYPSWYQQTPGQAPRTLIYYTNTRSSDVPERFSGSIVGNKAALTITGAQPDDESVYFCLLYLGRGIWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 90 - protein, 360 aa, Artificial Sequence
  Made in Lab - synthesized Wnt surrogate molecule
MYRMQLLSCIALSLALVTNSDVQLVESGGGLVQAGGSLRLACAGSGRIFAIYDIAWYRHPPGNQRELVAMIRPVVTEIDYADSVKGRFTISRNNAMKTVYLQMNNLKPEDTAVYYCNAKRPWGSRDEYWGQGTQVTVSSGSGGSQTVVLQEPSLSVSPGGTVTLTCGLSSGSVSTNYYPSWYQQTPGQAPRTLIYYTNTRSSDVPERFSGSIVGNKAALTITGAQPDDESVYFCLLYLGRGIWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 91 - protein, 365 aa, Artificial Sequence
  Made in Lab - synthesized Wnt surrogate molecule
MYRMQLLSCIALSLALVTNSEVQLVESGGGLVQAGGSLRVSCAASGGTFSRYHMGWFRQAPGKEREFVSAITWSGGRTYYADFVKGRFTISRDDARNTVYLQMSSLKPEDTAVYYCALTWAPTPTNRRSDYAYWGQGTQVTVSSGSGGSQTVVLQEPSLSVSPGGTVTLTCGLSSGSVSTNYYPSWYQQTPGQAPRTLIYYTNTRSSDVPERFSGSIVGNKAALTITGAQPDDESVYFCLLYLGRGIWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 92 - protein, 360 aa, Artificial Sequence
  Made in Lab - synthesized Wnt surrogate molecule
MYRMQLLSCIALSLALVTNSEVQLVESGGGLVQAGGSLRLACAGSGRIFAIYDMAWYRQAPGNQRELVATIRPVVSETTYADAVKGRFTISRSNAMKTVYLQMNSLKSEDTAIYYCNAKRPWGTRDEYWGQGTLVTVSSGSGGSQTVVLQEPSLSVSPGGTVTLTCGLSSGSVSTNYYPSWYQQTPGQAPRTLIYYTNTRSSDVPERFSGSIVGNKAALTITGAQPDDESVYFCLLYLGRGIWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 93 - protein, 360 aa, Artificial Sequence
  Made in Lab - synthesized Wnt surrogate molecule
MYRMQLLSCIALSLALVTNSAVQLVESGGGLVQAGGSLRLACAGSGRIFAIYDIAWYRQAPGNQRELVATIRPVVSETTYADAVKGRFTISRSNAMKTVYLQMNSLKSEDTAIYYCNAKRPWGTRDEYWGQGTLVTVSSGSGGSQTVVLQEPSLSVSPGGTVTLTCGLSSGSVSTNYYPSWYQQTPGQAPRTLIYYTNTRSSDVPERFSGSIVGNKAALTITGAQPDDESVYFCLLYLGRGIWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 94 - protein, 362 aa, Artificial Sequence
  Made in Lab - synthesized Wnt surrogate molecule
MYRMQLLSCIALSLALVTNSAVQLVDSGGGLVQAGGSLRLSCAVSGRTFSMYDMGWFRQAPGKEREFVASIRWSSGNTWYADSMKGRFTISRDNAKNTVYLQMNSLKPEDTAVYYCYANIYYTRRAPEEYWGQGTLVTVSSGSGGSQTVVLQEPSLSVSPGGTVTLTCGLSSGSVSTNYYPSWYQQTPGQAPRTLIYYTNTRSSDVPERFSGSIVGNKAALTITGAQPDDESVYFCLLYLGRGIWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 95 - protein, 472 aa, Artificial Sequence
  Made in Lab - synthesized Wnt surrogate molecule
MYRMQLLSCIALSLALVTNSEVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCASSKEKATYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 96 - protein, 357 aa, Artificial Sequence
  Made in Lab - synthesized Wnt surrogate molecule
MYRMQLLSCIALSLALVTNSEVQLVESGGGLVQPGGSLRLSCTSSANINSIETLGWYRQAPGKQRELIANMRGGGYMKYAGSLKGRFTMSTESAKNTLYLQMNSLKPEDTAVYYCYARTQRMGVVNSYWGQGTLVTVSSGSGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 97 - protein, 354 aa, Artificial Sequence
  Made in Lab - synthesized Wnt surrogate molecule
MYRMQLLSCIALSLALVTNSQVQLVESGGGLVQPGGSLRLSCTSSANINSIETLGWYRQAPGKQRELIANMRGGGYMKYAGSLKGRFTMSTESAKNTLYLQMNSLKPEDTAVYFCNAVTYDGYTIRGQGTLVTVSSGSGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 98 - protein, 362 aa, Artificial Sequence
  Made in Lab - synthesized Wnt surrogate molecule
MYRMQLLSCIALSLALVTNSEVQLVESGGGLVQPGGSLRLSCTSSANINSIETLGWYRQAPGKQRELIANMRGGGYMKYADSVQGRFTISRDNAKNTVYLQMNSLKPEDTAVYYCAAQFRNDYGLRYQSTNNYWGQGTLVTVSSGSGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 99 - protein, 353 aa, Artificial Sequence
  Made in Lab - synthesized Wnt surrogate molecule
MYRMQLLSCIALSLALVTNSQVQLVESGGGLVQPGGSLRLSCTSSANINSIETLGWYRQAPGKQRELIANMRGGGYMKYAGSLKGRFTMSTESAKNTVYLQMNSLKPEDSAVYYCNANYRGNRYWGQGTLVTVSSGSGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 100 - protein, 357 aa, Artificial Sequence
  Made in Lab - synthesized Wnt surrogate molecule
MYRMQLLSCIALSLALVTNSDVQLVESGGGLVQAGGSLRLACAGSGRIFAIYDIAWYRHPPGNQRELVAMIRPVVTEIDYADSVKGRFTISRNNAMKTVYLQMNNLKPEDTAVYYCNAKRPWGSRDEYWGQGTQVTVSSGSGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 101 - protein, 362 aa, Artificial Sequence
  Made in Lab - synthesized Wnt surrogate molecule
MYRMQLLSCIALSLALVTNSEVQLVESGGGLVQAGGSLRVSCAASGGTFSRYHMGWFRQAPGKEREFVSAITWSGGRTYYADFVKGRFTISRDDARNTVYLQMSSLKPEDTAVYYCALTWAPTPTNRRSDYAYWGQGTQVTVSSGSGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 102 - protein, 357 aa, Artificial Sequence
  Made in Lab - synthesized Wnt surrogate molecule
MYRMQLLSCIALSLALVTNSAVQLVESGGGLVQAGGSLRLACAGSGRIFAIYDIAWYRQAPGNQRELVATIRPVVSETTYADAVKGRFTISRSNAMKTVYLQMNSLKSEDTAIYYCNAKRPWGTRDEYWGQGTLVTVSSGSGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 103 - protein, 359 aa, Artificial Sequence
  Made in Lab - synthesized Wnt surrogate molecule
MYRMQLLSCIALSLALVTNSAVQLVDSGGGLVQAGGSLRLSCAVSGRTFSMYDMGWFRQAPGKEREFVASIRWSSGNTWYADSMKGRFTISRDNAKNTVYLQMNSLKPEDTAVYYCYANIYYTRRAPEEYWGQGTLVTVSSGSGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 104 - protein, 468 aa, Artificial Sequence
  Made in Lab - synthesized Wnt surrogate molecule
MYRMQLLSCIALSLALVTNSEVQLVESGGGLVQPGGSLRLSCAASGFTFSHYTLSWVRQAPGKGLEWVSVISGDGSYTYYADSVKGRFTISSDNSKNTLYLQMNSLRAEDTAVYYCARNFIKYVFANWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 105 - protein, 365 aa, Artificial Sequence
  Made in Lab - synthesized Wnt surrogate molecule
MDMRVPAQLLGLLLLWLRGARCDVQLVESGGGLVQAGGSLRLACAGSGRIFAIYDIAWYRHPPGNQRELVAMIRPVVTEIDYADSVKGRFTISRNNAMKTVYLQMNNLKPEDTAVYYCNAKRPWGSRDEYWGQGTQVTVSSGSGSGDVVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGTHWPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 106 - protein, 366 aa, Artificial Sequence
  Made in Lab - synthesized Wnt surrogate molecule
MDMRVPAQLLGLLLLWLRGARCDVQLVESGGGLVQAGGSLRLACAGSGRIFAIYDIAWYRHPPGNQRELVAMIRPVVTEIDYADSVKGRFTISRNNAMKTVYLQMNNLKPEDTAVYYCNAKRPWGSRDEYWGQGTQVTVSSGSGSGDIVMTHTPLSLSVTPGEPASISCRSSRSLLDTDDGNTYLDWYLQKPGQSPQLLIHTLSHRASGVPDRFSGSGSGTDFTLKISRVEAEDVGVYYCMQSIQLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 107 - protein, 359 aa, Artificial Sequence
  Made in Lab - synthesized Wnt surrogate molecule
MDMRVPAQLLGLLLLWLRGARCDVQLVESGGGLVQAGGSLRLACAGSGRIFAIYDIAWYRHPPGNQRELVAMIRPVVTEIDYADSVKGRFTISRNNAMKTVYLQMNNLKPEDTAVYYCNAKRPWGSRDEYWGQGTQVTVSSGSGSGSYVLTQPPSVSVSPGQTASITCSGDKVGHKYASWYQQKPGQSPVLVIYEDSQRPSGIPVRFSGSNSGNTATLTISGTQAMDEADYYCQAWDSSTDVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 108 - protein, 363 aa, Artificial Sequence
  Made in Lab - synthesized Wnt surrogate molecule
MDMRVPAQLLGLLLLWLRGARCDVQLVESGGGLVQAGGSLRLACAGSGRIFAIYDIAWYRHPPGNQRELVAMIRPVVTEIDYADSVKGRFTISRNNAMKTVYLQMNNLKPEDTAVYYCNAKRPWGSRDEYWGQGTQVTVSSGSGSGQSVVTQPPSVSGAPGQRVTISCTRSSSNIGAGYDVHWYQQHPGTAPKLLIFGNSIRPSGVPDRFSGSKSGTSATLGITGLQTGDEADYYCGTWDSSLSAWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 109 - protein, 360 aa, Artificial Sequence
  Made in Lab - synthesized Wnt surrogate molecule
MDMRVPAQLLGLLLLWLRGARCDVQLVESGGGLVQAGGSLRLACAGSGRIFAIYDIAWYRHPPGNQRELVAMIRPVVTEIDYADSVKGRFTISRNNAMKTVYLQMNNLKPEDTAVYYCNAKRPWGSRDEYWGQGTQVTVSSGSGSGEIVLTQSPATLSLSPGEGATLSCRASQSVGTYLTWYRQKPGQAPRLLIYDASNRATGIPARFSGSGAGTDFTLKISRVEAEDVGVYYCMQATQFPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 110 - protein, 360 aa, Artificial Sequence
  Made in Lab - synthesized Wnt surrogate molecule
MDMRVPAQLLGLLLLWLRGARCDVQLVESGGGLVQAGGSLRLACAGSGRIFAIYDIAWYRHPPGNQRELVAMIRPVVTEIDYADSVKGRFTISRNNAMKTVYLQMNNLKPEDTAVYYCNAKRPWGSRDEYWGQGTQVTVSSGSGSGDIQLTQSPSSLSASVGDRVTITCRASRSISSYFNWYQQKPGKAPKLLIYAASSLQSGVPSRFSGSRSGTDFTLTISSLQPEDFATYYCQQADTFPPTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 111 - protein, 483 aa, Artificial Sequence
  Made in Lab - synthesized Wnt surrogate molecule
MDMRVPAQLLGLLLLWLRGARCQVQLQESGPGLVKPSETLSLTCTVSGGSISGNNYYWGWIRQPPGKGLEWIGSIYFTGGTYYNPSLKSRVTISVDTSKNQFSLKLSSVTAADTAVYYCARVMLITDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGSGSGHHHHHH

SEQ ID NO: 112 - protein, 487 aa, Artificial Sequence
  Made in Lab - synthesized Wnt surrogate molecule
MDMRVPAQLLGLLLLWLRGARCQLQLQESGSGLVKPSQTLSLTCAVSGGSISSGGYSWSWIRQPPGKGLEWIGSIYHSGSTYYNPSLKSRLTISVDTSKNQFSLKLSSVTAADTAVYYCARFYYDILTGYSYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGSGSGHHHHHH

SEQ ID NO: 113 - protein, 487 aa, Artificial Sequence
  Made in Lab - synthesized Wnt surrogate molecule
MDMRVPAQLLGLLLLWLRGARCQVQLQQWGAGLLKPSETLSLTCAVSGASFSGHYWTWIRQPPGKGLEWIGEIDHTGSTNYEPSLRSRVTISVDTSKNQFSLNLKSVTAADTAVYYCARGGQGGYDWGHYHGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGSGSGHHHHHH

SEQ ID NO: 114 - protein, 483 aa, Artificial Sequence
  Made in Lab - synthesized Wnt surrogate molecule
MDMRVPAQLLGLLLLWLRGARCQVQLQESGPGLVKPSETLSLTCTVSGGSISSSSYYWGWIRQHPGKGLEWIGYIYYSGSTYYNPSLKSRVTISVDTSKNQFSLKLNSVTAADTAVYYCARATYGGDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGSGSGHHHHHH

SEQ ID NO: 115 - protein, 484 aa, Artificial Sequence
  Made in Lab - synthesized Wnt surrogate molecule
MDMRVPAQLLGLLLLWLRGARCQVQLQESGPGLVKPSETLSLTCTVSGGAISGTSYFWGWIRQPPGKGLEWIGSIYYTGNTYYNPSLKSRLTVSVDTSKNQFSLNLNSVTAADTATYYCARIGIAVAAPVDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGSGSGHHHHHH

SEQ ID NO: 116 - protein, 490 aa, Artificial Sequence
  Made in Lab - synthesized Wnt surrogate molecule
MDMRVPAQLLGLLLLWLRGARCQLQLQESGPGLVKPSQTLSLTCTVSGGSISSGGYYWSWIRQHPGKGLEWIGYIYYSGSTYYNPSLKSRVTISVDKSKNQFSLKLSSVTAADTAVYYCARVRDYYDSSGYYYDYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGSGSGHHHHHH

SEQ ID NO: 117 - protein, 598 aa, Artificial Sequence
  Made in Lab - synthesized Wnt surrogate molecule
MDMRVPAQLLGLLLLWLRGARCEVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCASSKEKATYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGSGSGDVQLVESGGGLVQAGGSLRLACAGSGRIFAIYDIAWYRHPPGNQRELVAMIRPVVTEIDYADSVKGRFTISRNNAMKTVYLQMNNLKPEDTAVYYCNAKRPWGSRDEYWGQGTQVTVSS

SEQ ID NO: 118 - protein, 598 aa, Artificial Sequence
  Made in Lab - synthesized Wnt surrogate molecule
MDMRVPAQLLGLLLLWLRGARCDVQLVESGGGLVQAGGSLRLACAGSGRIFAIYDIAWYRHPPGNQRELVAMIRPVVTEIDYADSVKGRFTISRNNAMKTVYLQMNNLKPEDTAVYYCNAKRPWGSRDEYWGQGTQVTVSSGSGSGEVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCASSKEKATYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 119 - protein, 362 aa, Artificial Sequence
  Made in Lab - synthesized Wnt surrogate molecule
MDMRVPAQLLGLLLLWLRGARCQAVVLQEPSLSVSPGGTVTLTCGLSSGSVSTNYYPSWYQQTPGQAPRTLIYYTNTRSSDVPERFSGSIVGNKAALTITGAQPDDESVYFCLLYLGRGIWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECSGSGSGDVQLVESGGGLVQAGGSLRLACAGSGRIFAIYDIAWYRHPPGNQRELVAMIRPVVTEIDYADSVKGRFTISRNNAMKTVYLQMNNLKPEDTAVYYCNAKRPWGSRDEYWGQGTQVTVSS

SEQ ID NO: 120 - protein, 362 aa, Artificial Sequence
  Made in Lab - synthesized Wnt surrogate molecule
MDMRVPAQLLGLLLLWLRGARCDVQLVESGGGLVQAGGSLRLACAGSGRIFAIYDIAWYRHPPGNQRELVAMIRPVVTEIDYADSVKGRFTISRNNAMKTVYLQMNNLKPEDTAVYYCNAKRPWGSRDEYWGQGTQVTVSSGSGSGQAVVLQEPSLSVSPGGTVTLTCGLSSGSVSTNYYPSWYQQTPGQAPRTLIYYTNTRSSDVPERFSGSIVGNKAALTITGAQPDDESVYFCLLYLGRGIWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 121 - skipped

SEQ ID NO: 122 - protein, 258 aa, Artificial Sequence
  Made in Lab - synthesized Wnt surrogate molecule
MDMRVPAQLLGLLLLWLRGARCEVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCASSKEKATYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGSGSGHHHHHH

SEQ ID NO: 123 - protein, 362 aa, Artificial Sequence; identical to SEQ ID NO: 94
  Made in Lab - synthesized Wnt surrogate molecule

SEQ ID NO: 124 - protein, 254 aa, Artificial Sequence
  Made in Lab - synthesized Wnt surrogate molecule
MYRMQLLSCIALSLALVTNSEVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCASSKEKATYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGSGHHHHHH

SEQ ID NO: 125 - protein, 238 aa, Artificial Sequence
  Made in Lab - synthesized Wnt surrogate molecule
MDMRVPAQLLGLLLLWLRGARCQAVVLQEPSLSVSPGGTVTLTCGLSSGSVSTNYYPSWYQQTPGQAPRTLIYYTNTRSSDVPERFSGSIVGNKAALTITGAQPDDESVYFCLLYLGRGIWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 126 - protein, 474 aa, Artificial Sequence
  Made in Lab - synthesized Wnt surrogate molecule
MDMRVPAQLLGLLLLWLRGARCEVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCASSKEKATYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 127 - protein, 379 aa, Artificial Sequence
  Made in Lab - synthesized Wnt surrogate molecule
MDMRVPAQLLGLLLLWLRGARCDVQLVESGGGLVQAGGSLRLACAGSGRIFAIYDIAWYRHPPGNQRELVAMIRPVVTEIDYADSVKGRFTISRNNAMKTVYLQMNNLKPEDTAVYYCNAKRPWGSRDEYWGQGTQVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGKGSGSGHHHHHH

SEQ ID NO: 128 - protein, 489 aa, Artificial Sequence
  Made in Lab - synthesized Wnt surrogate molecule
MDMRVPAQLLGLLLLWLRGARCDVQLVESGGGLVQAGGSLRLACAGSGRIFAIYDIAWYRHPPGNQRELVAMIRPVVTEIDYADSVKGRFTISRNNAMKTVYLQMNNLKPEDTAVYYCNAKRPWGSRDEYWGQGTQVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGSGSAVQQVESGGGLVQPGGSLRLSCAASGFTLDYYAISWFRQAPGKKRELVADITSGGSTNYADSVKGRFTISRDNAKNTIYLQMNSLKPEDTAVYFCNAVTYNGYTIWGQGTQVTVSS

SEQ ID NO: 129 - protein, 120 aa, Artificial Sequence
  Made in Lab - 004S-D01 Heavy Chain
EVQLVESGGGLVKPGGSLRLSCAASGFTFTNYAMSWVRQAPGKGLEWVSAISGSGGSTYYADSVKGRFTISRDDSKNTLYLQMNSLKTEDTAVYYCARATGFGTVVFDYWGQGTLVTVSS

SEQ ID NO: 130 - protein, 107 aa, Artificial Sequence [sequence omitted]

SEQ ID NO: 131 - protein, 119 aa, Artificial Sequence
  Mad in Lab - 004S-E09 Heavy Chain
QVQLVQSGAEVKKPGASVKVSCKASGDTFSNYVISWVRQAPGQGLEWMGRISAYNGYKSYAQNFQGRVTMTRDTSTSTVYMELSSLRSEDTAVYYCARSSGYVGWFDPWGQGTLVTVSS

SEQ ID NO: 132 - protein, 107 aa, Artificial Sequence [sequence omitted]

SEQ ID NO: 133 - protein, 117 aa, Artificial Sequence
  Made in Lab - 008S-D01 Heavy Chain
DVQLVESGGGLVQPGGSLRLSCTSSANINSIETLGWYRQAPGKQRELIANMRGGGYMKYAGSLKGRFTMSTESAKNTMYLQMNSLKPEDTAVYYCYVKLRDDDYVYRGQGTQVTVSS

SEQ ID NO: 134 - protein, 357 aa, Artificial Sequence
  Made in Lab - synthesized Wnt surrogate molecule
MDMRVPAQLLGLLLLWLRGARCDVQLVESGGGLVQPGGSLRLSCTSSANINSIETLGWYRQAPGKQRELIANMRGGGYMKYAGSLKGRFTMSTESAKNTMYLQMNSLKPEDTAVYYCYVKLRDDDYVYRGQGTQVTVSSGSGSGSYVLTQPPSVSVSPGQTASITCSGDKVGHKYASWYQQKPGQSPVLVIYEDSQRPSGIPVRFSGSNSGNTATLTISGTQAMDEADYYCQAWDSSTDVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 135 - protein, 351 aa, Artificial Sequence
  Made in Lab - synthesized Wnt surrogate molecule
MDMRVPAQLLGLLLLWLRGARCQVKLEESGGGLVQAGGSLRLSCAASGRIFSIYDMGWFRQAPGKEREFVSGIRWSGGTSYADSVKGRFTISKDNAKNTIYLQMNNLKAEDTAVYYCGSRGYWGQGTLVTVSSGSGSGSYVLTQPPSVSVSPGQTASITCSGDKVGHKYASWYQQKPGQSPVLVIYEDSQRPSGIPVRFSGSNSGNTATLTISGTQAMDEADYYCQAWDSSTDVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 136 - protein, 361 aa, Artificial Sequence
  Made in Lab - synthesized Wnt surrogate molecule
MDMRVPAQLLGLLLLWLRGARCDVQLVESGGGLVQPGGSLRLSCTSSANINSIETLGWYRQAPGKQRELIANMRGGGYMKYAGSLKGRFTMSTESAKNTMYLQMNSLKPEDTAVYYCYVKLRDDDYVYRGQGTQVTVSSGGSGSGSGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 137 - protein, 360 aa, Artificial Sequence
  Made in Lab - synthesized Wnt surrogate molecule
MDMRVPAQLLGLLLLWLRGARCDVQLVESGGGLVQAGGSLRLACAGSGRIFAIYDIAWYRHPPGNQRELVAMIRPVVTEIDYADSVKGRFTISRNNAMKTVYLQMNNLKPEDTAVYYCNAKRPWGSRDEYWGQGTQVTVSSGSGSGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 138 - protein, 352 aa, Artificial Sequence
  Made in Lab - synthesized Wnt surrogate molecule
MDMRVPAQLLGLLLLWLRGARCQVKLEESGGGLVQAGGSLRLSCAASGRIFSIYDMGWFRQAPGKEREFVSGIRWSGGTSYADSVKGRFTISKDNAKNTIYLQMNNLKAEDTAVYYCGSRGYWGQGTLVTVSSGSGSGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 139 - protein, 360 aa, Artificial Sequence
  Made in Lab - synthesized Wnt surrogate molecule
MDMRVPAQLLGLLLLWLRGARCDVQLVESGGGLVQPGGSLRLSCTSSANINSIETLGWYRQAPGKQRELIANMRGGGYMKYAGSLKGRFTMSTESAKNTMYLQMNSLKPEDTAVYYCYVKLRDDDYVYRGQGTQVTVSSGSGSGQAVVLQEPSLSVSPGGTVTLTCGLSSGSVSTNYYPSWYQQTPGQAPRTLIYYTNTRSSDVPERFSGSIVGNKAALTITGAQPDDESVYFCLLYLGRGIWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 140 - protein, 354 aa, Artificial Sequence
  Made in Lab - synthesized Wnt surrogate molecule
MDMRVPAQLLGLLLLWLRGARCQVKLEESGGGLVQAGGSLRLSCAASGRIFSIYDMGWFRQAPGKEREFVSGIRWSGGTSYADSVKGRFTISKDNAKNTIYLQMNNLKAEDTAVYYCGSRGYWGQGTLVTVSSGSGSGQAVVLQEPSLSVSPGGTVTLTCGLSSGSVSTNYYPSWYQQTPGQAPRTLIYYTNTRSSDVPERFSGSIVGNKAALTITGAQPDDESVYFCLLYLGRGIWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 141 - protein, 358 aa, Artificial Sequence
  Made in Lab - synthesized Wnt surrogate molecule
MDMRVPAQLLGLLLLWLRGARCDVQLVESGGGLVQPGGSLRLSCTSSANINSIETLGWYRQAPGKQRELIANMRGGGYMKYAGSLKGRFTMSTESAKNTMYLQMNSLKPEDTAVYYCYVKLRDDDYVYRGQGTQVTVSSGGSGSDIQMTQSPSSLSASVGDRVTITCRASQGISSYLAWYQQKPGKAPKLLIYAASNLLGGVPSRFSGSGSGTDFTLTISSLQPEDFATYYCQQTYSTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 142 - protein, 360 aa, Artificial Sequence
  Made in Lab - synthesized Wnt surrogate molecule
MDMRVPAQLLGLLLLWLRGARCDVQLVESGGGLVQAGGSLRLACAGSGRIFAIYDIAWYRHPPGNQRELVAMIRPVVTEIDYADSVKGRFTISRNNAMKTVYLQMNNLKPEDTAVYYCNAKRPWGSRDEYWGQGTQVTVSSGSGGSDIQMTQSPSSLSASVGDRVTITCRASQGISSYLAWYQQKPGKAPKLLIYAASNLLGGVPSRFSGSGSGTDFTLTISSLQPEDFATYYCQQTYSTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 143 - protein, 352 aa, Artificial Sequence
  Made in Lab - synthesized Wnt surrogate molecule
MDMRVPAQLLGLLLLWLRGARCQVKLEESGGGLVQAGGSLRLSCAASGRIFSIYDMGWFRQAPGKEREFVSGIRWSGGTSYADSVKGRFTISKDNAKNTIYLQMNNLKAEDTAVYYCGSRGYWGQGTLVTVSSGGSGSDIQMTQSPSSLSASVGDRVTITCRASQGISSYLAWYQQKPGKAPKLLIYAASNLLGGVPSRFSGSGSGTDFTLTISSLQPEDFATYYCQQTYSTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 144 - protein, 358 aa, Artificial Sequence
  Made in Lab - synthesized Wnt surrogate molecule
MDMRVPAQLLGLLLLWLRGARCDVQLVESGGGLVQPGGSLRLSCTSSANINSIETLGWYRQAPGKQRELIANMRGGGYMKYAGSLKGRFTMSTESAKNTMYLQMNSLKPEDTAVYYCYVKLRDDDYVYRGQGTQVTVSSGGSGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 145 - protein, 360 aa, Artificial Sequence
  Made in Lab - synthesized Wnt surrogate molecule
MDMRVPAQLLGLLLLWLRGARCDVQLVESGGGLVQAGGSLRLACAGSGRIFAIYDIAWYRHPPGNQRELVAMIRPVVTEIDYADSVKGRFTISRNNAMKTVYLQMNNLKPEDTAVYYCNAKRPWGSRDEYWGQGTQVTVSSGGSGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 146 - protein, 352 aa, Artificial Sequence
  Made in Lab - synthesized Wnt surrogate molecule
MDMRVPAQLLGLLLLWLRGARCQVKLEESGGGLVQAGGSLRLSCAASGRIFSIYDMGWFRQAPGKEREFVSGIRWSGGTSYADSVKGRFTISKDNAKNTIYLQMNNLKAEDTAVYYCGSRGYWGQGTLVTVSSGGSGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 147 - protein, 358 aa, Artificial Sequence; identical to SEQ ID NO: 144
  Made in Lab - synthesized Wnt surrogate molecule

SEQ ID NO: 148 - protein, 360 aa, Artificial Sequence; identical to SEQ ID NO: 145
  Made in Lab - synthesized Wnt surrogate molecule

SEQ ID NO: 149 - protein, 352 aa, Artificial Sequence; identical to SEQ ID NO: 146
  Made in Lab - synthesized Wnt surrogate molecule

SEQ ID NO: 150 - protein, 358 aa, Artificial Sequence
  Made in Lab - synthesized Wnt surrogate molecule
MDMRVPAQLLGLLLLWLRGARCDVQLVESGGGLVQPGGSLRLSCTSSANINSIETLGWYRQAPGKQRELIANMRGGGYMKYAGSLKGRFTMSTESAKNTMYLQMNSLKPEDTAVYYCYVKLRDDDYVYRGQGTQVTVSSGSGSGDIQMTQSPSSLSASVGDRVTITCRASQSISSYLNWYQQKPGKAPKLLIYAASSLQSGVPSRFSGSGSGTDFTLTISSLQPEDFATYYCQQSYRTPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 151 - protein, 360 aa, Artificial Sequence
  Made in Lab - synthesized Wnt surrogate molecule
MDMRVPAQLLGLLLLWLRGARCDVQLVESGGGLVQAGGSLRLACAGSGRIFAIYDIAWYRHPPGNQRELVAMIRPVVTEIDYADSVKGRFTISRNNAMKTVYLQMNNLKPEDTAVYYCNAKRPWGSRDEYWGQGTQVTVSSGSGSGDIQMTQSPSSLSASVGDRVTITCRASQSISSYLNWYQQKPGKAPKLLIYAASSLQSGVPSRFSGSGSGTDFTLTISSLQPEDFATYYCQQSYRTPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 152 - protein, 352 aa, Artificial Sequence
  Made in Lab - synthesized Wnt surrogate molecule
MDMRVPAQLLGLLLLWLRGARCQVKLEESGGGLVQAGGSLRLSCAASGRIFSIYDMGWFRQAPGKEREFVSGIRWSGGTSYADSVKGRFTISKDNAKNTIYLQMNNLKAEDTAVYYCGSRGYWGQGTLVTVSSGSGSGDIQMTQSPSSLSASVGDRVTITCRASQSISSYLNWYQQKPGKAPKLLIYAASSLQSGVPSRFSGSGSGTDFTLTISSLQPEDFATYYCQQSYRTPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 153 - protein, 474 aa, Artificial Sequence
  Made in Lab - synthesized Wnt surrogate molecule
MDMRVPAQLLGLLLLWLRGARCEVQLLQSGAEVKKPGSSVKVSCKASGGTFTYRYLHWVRQAPGQGLEWMGGIIPIFGTGNYAQKFQGRVTITADESTSTAYMELSSLRSEDTAVYYCASSMVRVPYYYGMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 154 - protein, 470 aa, Artificial Sequence
  Made in Lab - synthesized Wnt surrogate molecule
MDMRVPAQLLGLLLLWLRGARCEVQLVESGGGLVKPGGSLRLSCAASGFNFGIYSMTWVRQAPGKGLEWISYISGDSGYTNYADSVKGRFTISRDDSKNTLYLQMNSLKTEDTAVYYCARVGPGGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 155 - protein, 472 aa, Artificial Sequence
  Made in Lab - synthesized Wnt surrogate molecule
MDMRVPAQLLGLLLLWLRGARCEVQLVESGGGLVKPGGSLRLSCAASGFTFTNYAMSWVRQAPGKGLEWVSAISGSGGSTYYADSVKGRFTISRDDSKNTLYLQMNSLKTEDTAVYYCARATGFGTVVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 156 - protein, 476 aa, Artificial Sequence
  Made in Lab - synthesized Wnt surrogate molecule
MDMRVPAQLLGLLLLWLRGARCEVQLVQSGGGLVKPGGSLRLSCAASGFTFSSYSMNWVRQAPGKGLEWVSYIENDGSITTYADSVKGRFTISRDDSKNTLYLQMNSLKTEDTAVYYCARAPYYYGSGSLFRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 157 - protein, 481 aa, Artificial Sequence
  Made in Lab - synthesized Wnt surrogate molecule
MDMRVPAQLLGLLLLWLRGARCQVQLVQSGAEVKKPGSSVKVSCKASGYTFTNNFMHWVRQAPGQGLEWMGWINPNSGGTKYAQKFQGRVTITADESTSTAYMELSSLRSEDTAVYYCARSVGEVGATMLGIGVWYWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 158 - protein, 9 aa, Artificial Sequence
  Synthesized molecular recognition unit - heavy CDR1
ASFSGHYWT

SEQ ID NO: 159 - protein, 11 aa, Artificial Sequence
  Synthesized molecular recognition unit - heavy CDR1
ASVSSNSAAWN

SEQ ID NO: 160 - protein, 11 aa, Artificial Sequence
  Synthesized molecular recognition unit - heavy CDR1
DSVSSNSAAWN

SEQ ID NO: 161 - protein, 11 aa, Artificial Sequence
  Synthesized molecular recognition unit - heavy CDR1
DSVSSNSATWN

SEQ ID NO: 162 - protein, 11 aa, Artificial Sequence
  Synthesized molecular recognition unit - heavy CDR1
DSVSSNSGAWN

SEQ ID NO: 163 - protein, 9 aa, Artificial Sequence
  Synthesized molecular recognition unit - heavy CDR1
DTFSNYVIS

SEQ ID NO: 164 - protein, 9 aa, Artificial Sequence
  Synthesized molecular recognition unit - heavy CDR1
DTFSNYVLS

SEQ ID NO: 165 - protein, 9 aa, Artificial Sequence
  Synthesized molecular recognition unit - heavy CDR1
FAFDDYAMH

SEQ ID NO: 166 - protein, 9 aa, Artificial Sequence
  Synthesized molecular recognition unit - heavy CDR1
FAFSSHWMH

SEQ ID NO: 167 - protein, 9 aa, Artificial Sequence
  Synthesized molecular recognition unit - heavy CDR1
FAFSSYAMS

SEQ ID NO: 168 - protein, 9 aa, Artificial Sequence
  Synthesized molecular recognition unit - heavy CDR1
FAVSSSYMS

SEQ ID NO: 169 - protein, 9 aa, Artificial Sequence
  Synthesized molecular recognition unit - heavy CDR1
FFFSGYWMS

SEQ ID NO: 170 - protein, 9 aa, Artificial Sequence
  Synthesized molecular recognition unit - heavy CDR1
FIFSDYYMS

SEQ ID NO: 171 - protein, 9 aa, Artificial Sequence
  Synthesized molecular recognition unit - heavy CDR1
FIFSZYAMS

SEQ ID NO: 172 - protein, 9 aa, Artificial Sequence
  Synthesized molecular recognition unit - heavy CDR1
FNFGIYSMT

SEQ ID NO: 173 - protein, 9 aa, Artificial Sequence
  Synthesized molecular recognition unit - heavy CDR1
FNFSSYTMR

SEQ ID NO: 174 - protein, 9 aa, Artificial Sequence
  Synthesized molecular recognition unit - heavy CDR1
FNIRRZNMZ

SEQ ID NO: 175 - protein, 9 aa, Artificial Sequence
  Synthesized molecular recognition unit - heavy CDR1
FNLRRYNMN

SEQ ID NO: 176 - protein, 9 aa, Artificial Sequence
  Synthesized molecular recognition unit - heavy CDR1
FPFSTFSMN

SEQ ID NO: 177 - protein, 9 aa, Artificial Sequence
  Synthesized molecular recognition unit - heavy CDR1
FRFISHPIH

SEQ ID NO: 178 - protein, 9 aa, Artificial Sequence
  Synthesized molecular recognition unit - heavy CDR1
FSFRSYSMS

SEQ ID NO: 179 - protein, 9 aa, Artificial Sequence
  Synthesized molecular recognition unit - heavy CDR1
FSFSKKYMT

SEQ ID NO: 180 - protein, 9 aa, Artificial Sequence
  Synthesized molecular recognition unit - heavy CDR1
FSFSRYGMS

SEQ ID NO: 181 - protein, 9 aa, Artificial Sequence
  Synthesized molecular recognition unit - heavy CDR1
FSFSSTAMS

SEQ ID NO: 182 - protein, 9 aa, Artificial Sequence
  Synthesized molecular recognition unit - heavy CDR1
FSFSSYGMH

SEQ ID NO: 183 - protein, 9 aa, Artificial Sequence
  Synthesized molecular recognition unit - heavy CDR1
FSFSSYGMS

SEQ ID NO: 184 - protein, 9 aa, Artificial Sequence
  Synthesized molecular recognition unit - heavy CDR1
FSFSTYTMS

SEQ ID NO: 185 - protein, 9 aa, Artificial Sequence
  Synthesized molecular recognition unit - heavy CDR1
FSLSSYGMH

SEQ ID NO: 186 - protein, 9 aa, Artificial Sequence
  Synthesized molecular recognition unit - heavy CDR1
FSVGSNYMT

SEQ ID NO: 187 - protein, 9 aa, Artificial Sequence
  Synthesized molecular recognition unit - heavy CDR1
FSVSSNYMN

SEQ ID NO: 188 - protein, 9 aa, Artificial Sequence
  Synthesized molecular recognition unit - heavy CDR1
FTFADYGMH

SEQ ID NO: 189 - protein, 9 aa, Artificial Sequence
  Synthesized molecular recognition unit - heavy CDR1
FTFANYAMH

SEQ ID NO: 190 - protein, 9 aa, Artificial Sequence
  Synthesized molecular recognition unit - heavy CDR1
FTFANYAMN

SEQ ID NO: 191 - protein, 9 aa, Artificial Sequence
  Synthesized molecular recognition unit - heavy CDR1
FTFDDYAMH

SEQ ID NO: 192 - protein, 9 aa, Artificial Sequence
  Synthesized molecular recognition unit - heavy CDR1
FTFDDYGMH

SEQ ID NO: 193 - protein, 9 aa, Artificial Sequence
  Synthesized molecular recognition unit - heavy CDR1
FTFDDYYMN

SEQ ID NO: 194 - protein, 9 aa, Artificial Sequence
  Synthesized molecular recognition unit - heavy CDR1
FTFDHNPMN

SEQ ID NO: 195 - protein, 9 aa, Artificial Sequence
  Synthesized molecular recognition unit - heavy CDR1
FTFGNYDMN

SEQ ID NO: 196 - protein, 9 aa, Artificial Sequence
  Synthesized molecular recognition unit - heavy CDR1
FTFGTYWVT

SEQ ID NO: 197 - protein, 9 aa, Artificial Sequence
  Synthesized molecular recognition unit - heavy CDR1
FTFNRHALS

SEQ ID NO: 198 - protein, 9 aa, Artificial Sequence
  Synthesized molecular recognition unit - heavy CDR1
FTFRDYAMN

SEQ ID NO: 199 - protein, 9 aa, Artificial Sequence
  Synthesized molecular recognition unit - heavy CDR1
FTFREYAMT

SEQ ID NO: 200 - protein, 9 aa, Artificial Sequence
  Synthesized molecular recognition unit - heavy CDR1
FTFRMYGMH

SEQ ID NO: 201 - protein, 9 aa, Artificial Sequence
  Synthesized molecular recognition unit - heavy CDR1
FTFRNSAMH

SEQ ID NO: 202 - protein, 9 aa, Artificial Sequence
  Synthesized molecular recognition unit - heavy CDR1
FTFRSYGMH

SEQ ID NO: 203 - protein, 9 aa, Artificial Sequence
  Synthesized molecular recognition unit - heavy CDR1
FTFSDFGMN

SEQ ID NO: 204 - protein, 9 aa, Artificial Sequence
  Synthesized molecular recognition unit - heavy CDR1
FTFSDHYMD

SEQ ID NO: 205 - protein, 9 aa, Artificial Sequence
  Synthesized molecular recognition unit - heavy CDR1
FTFSDHYMS

SEQ ID NO: 206 - protein, 9 aa, Artificial Sequence
  Synthesized molecular recognition unit - heavy CDR1
FTFSDSYMS

SEQ ID NO: 207 - protein, 9 aa, Artificial Sequence
  Synthesized molecular recognition unit - heavy CDR1
FTFSDYGMH

SEQ ID NO: 208 - protein, 9 aa, Artificial Sequence
  Synthesized molecular recognition unit - heavy CDR1
FTFSDYYMS

SEQ ID NO: 209 - protein, 9 aa, Artificial Sequence
  Synthesized molecular recognition unit - heavy CDR1
FTFSIYGMH

SEQ ID NO: 210 - protein, 9 aa, Artificial Sequence
  Synthesized molecular recognition unit - heavy CDR1
FTFSNAQMS

SEQ ID NO: 211 - protein, 9 aa, Artificial Sequence
  Synthesized molecular recognition unit - heavy CDR1
FTFSNAWMS

SEQ ID NO: 212 - protein, 9 aa, Artificial Sequence
  Synthesized molecular recognition unit - heavy CDR1
FTFSNHYMS

SEQ ID NO: 213 - protein, 9 aa, Artificial Sequence
  Synthesized molecular recognition unit - heavy CDR1
FTFSNHYTS

SEQ ID NO: 214 - protein, 9 aa, Artificial Sequence
  Synthesized molecular recognition unit - heavy CDR1
FTFSNSDMN

SEQ ID NO: 215 - protein, 9 aa, Artificial Sequence
  Synthesized molecular recognition unit - heavy CDR1
FTFSNYAMH

SEQ ID NO: 216 - protein, 9 aa, Artificial Sequence
  Synthesized molecular recognition unit - heavy CDR1
FTFSNYAMT

SEQ ID NO: 217 - protein, 9 aa, Artificial Sequence
  Synthesized molecular recognition unit - heavy CDR1
FTFSNYGMH

SEQ ID NO: 218 - protein, 9 aa, Artificial Sequence
  Synthesized molecular recognition unit - heavy CDR1
FTFSNYYTS

SEQ ID NO: 219 - protein, 9 aa, Artificial Sequence
  Synthesized molecular recognition unit - heavy CDR1
FTFSRYAMH

SEQ ID NO: 220 - protein, 9 aa, Artificial Sequence
  Synthesized molecular recognition unit - heavy CDR1
FTFSRYAMS

SEQ ID NO: 221 - protein, 9 aa, Artificial Sequence
  Synthesized molecular recognition unit - heavy CDR1
FTFSSFGMH

SEQ ID NO: 222 - protein, 9 aa, Artificial Sequence
  Synthesized molecular recognition unit - heavy CDR1
FTFSSHSTH

SEQ ID NO: 223 - protein, 9 aa, Artificial Sequence
  Synthesized molecular recognition unit - heavy CDR1
FTFSSNAMH

SEQ ID NO: 224 - protein, 9 aa, Artificial Sequence
  Synthesized molecular recognition unit - heavy CDR1
FTFSSSAMH

SEQ ID NO: 225 - protein, 9 aa, Artificial Sequence
  Synthesized molecular recognition unit - heavy CDR1
FTFSSSNMN

SEQ ID NO: 226 - protein, 9 aa, Artificial Sequence
  Synthesized molecular recognition unit - heavy CDR1
FTFSSSWMH

SEQ ID NO: 227 - protein, 9 aa, Artificial Sequence
  Synthesized molecular recognition unit - heavy CDR1
FTFSSYAMH

SEQ ID NO: 228 - protein, 9 aa, Artificial Sequence
  Synthesized molecular recognition unit - heavy CDR1
FTFSSYAMS

SEQ ID NO: 229 - protein, 9 aa, Artificial Sequence
  Synthesized molecular recognition unit - heavy CDR1
FTFSSYDMN

SEQ ID NO: 230 - protein, 9 aa, Artificial Sequence
  Synthesized molecular recognition unit - heavy CDR1
FTFSSYGMH

SEQ ID NO: 231 - protein, 9 aa, Artificial Sequence
  Synthesized molecular recognition unit - heavy CDR1
FTFSSYGMS

SEQ ID NO: 232 - protein, 9 aa, Artificial Sequence
  Synthesized molecular recognition unit - heavy CDR1
FTFSSYNMN

SEQ ID NO: 233 - protein, 9 aa, Artificial Sequence
  Synthesized molecular recognition unit - heavy CDR1
FTFSSYSMN

SEQ ID NO: 234 - protein, 9 aa, Artificial Sequence
  Synthesized molecular recognition unit - heavy CDR1
FTFSSYSMS

SEQ ID NO: 235 - protein, 9 aa, Artificial Sequence
  Synthesized molecular recognition unit - heavy CDR1
FTFSSYTMN

SEQ ID NO: 236 - protein, 9 aa, Artificial Sequence
  Synthesized molecular recognition unit - heavy CDR1
FTFSSYTMS

SEQ ID NO: 237 - protein, 9 aa, Artificial Sequence
  Synthesized molecular recognition unit - heavy CDR1
FTFSSYVMS

SEQ ID NO: 238 - protein, 9 aa, Artificial Sequence
  Synthesized molecular recognition unit - heavy CDR1
FTFSSYWIH

SEQ ID NO: 239 - protein, 9 aa, Artificial Sequence
  Synthesized molecular recognition unit - heavy CDR1
FTFSSYWMH

SEQ ID NO: 240 - protein, 9 aa, Artificial Sequence
  Synthesized molecular recognition unit - heavy CDR1
FTFSSZZMH

SEQ ID NO: 241 - protein, 9 aa, Artificial Sequence
  Synthesized molecular recognition unit - heavy CDR1
  misc_feature (6)..(6): Xaa can be any naturally occurring amino acid
FTFSTXWMS

SEQ ID NO: 242 - protein, 9 aa, Artificial Sequence
  Synthesized molecular recognition unit - heavy CDR1
FTFSTYAMH

SEQ ID NO: 243 - protein, 9 aa, Artificial Sequence
  Synthesized molecular recognition unit - heavy CDR1
FTFSTYEMN

SEQ ID NO: 244 - protein, 9 aa, Artificial Sequence
  Synthesized molecular recognition unit - heavy CDR1
FTFSTYGMH

SEQ ID NO: 245 - protein, 9 aa, Artificial Sequence
  Synthesized molecular recognition unit - heavy CDR1
FTFSTYSMI

SEQ ID NO: 246 - protein, 9 aa, Artificial Sequence
  Synthesized molecular recognition unit - heavy CDR1
FTFSTYSMS

SEQ ID NO: 247 - protein, 9 aa, Artificial Sequence
  Synthesized molecular recognition unit - heavy CDR1
FTFTGSAVQ

SEQ ID NO: 248 - protein, 9 aa, Artificial Sequence
  Synthesized molecular recognition unit - heavy CDR1
FTFTNYAMS

SEQ ID NO: 249 - protein, 9 aa, Artificial Sequence
  Synthesized molecular recognition unit - heavy CDR1
FTFTSSAMQ

SEQ ID NO: 250 - protein, 9 aa, Artificial Sequence
  Synthesized molecular recognition unit - heavy CDR1
FTFTSSATQ

SEQ ID NO: 251 - protein, 9 aa, Artificial Sequence
  Synthesized molecular recognition unit - heavy CDR1
FTFTSSAVQ

SEQ ID NO: 252 - protein, 9 aa, Artificial Sequence
  Synthesized molecular recognition unit - heavy CDR1
FTFTSYAMH

SEQ ID NO: 253 - protein, 9 aa, Artificial Sequence
  Synthesized molecular recognition unit - heavy CDR1
FTFTZSAVQ

SEQ ID NO: 254 - protein, 9 aa, Artificial Sequence
  Synthesized molecular recognition unit - heavy CDR1
FTFZZSZVQ

SEQ ID NO: 255 - protein, 9 aa, Artificial Sequence
  Synthesized molecular recognition unit - heavy CDR1
FTLDYYAIS

SEQ ID NO: 256 - protein, 9 aa, Artificial Sequence
  Synthesized molecular recognition unit - heavy CDR1
FTLSSHHMN

SEQ ID NO: 257 - protein, 9 aa, Artificial Sequence
  Synthesized molecular recognition unit - heavy CDR1
FTLSTYNMN

SEQ ID NO: 258 - protein, 9 aa, Artificial Sequence
  Synthesized molecular recognition unit - heavy CDR1
FTVGNNYMS

SEQ ID NO: 259 - protein, 9 aa, Artificial Sequence
  Synthesized molecular recognition unit - heavy CDR1
FTVGSWYMS

SEQ ID NO: 260 - protein, 9 aa, Artificial Sequence
  Synthesized molecular recognition unit - heavy CDR1
FTVSSHSMG

SEQ ID NO: 261 - protein, 9 aa, Artificial Sequence
  Synthesized molecular recognition unit - heavy CDR1
FTVSSNYMN

SEQ ID NO: 262 - protein, 9 aa, Artificial Sequence
  Synthesized molecular recognition unit - heavy CDR1
FTVSSNYMS

SEQ ID NO: 263 - protein, 9 aa, Artificial Sequence
  Synthesized molecular recognition unit - heavy CDR1
FTZSSYDMH

SEQ ID NO: 264 - protein, 9 aa, Artificial Sequence
  Synthesized molecular recognition unit - heavy CDR1
FTZSSYSMN

SEQ ID NO: 265 - protein, 9 aa, Artificial Sequence
  Synthesized molecular recognition unit - heavy CDR1
GAFSTSSIS

SEQ ID NO: 266 - protein, 11 aa, Artificial Sequence
  Synthesized molecular recognition unit - heavy CDR1
GAISGTSYFWG

SEQ ID NO: 267 - protein, 9 aa, Artificial Sequence
  Synthesized molecular recognition unit - heavy CDR1
GDFTNYAMA

SEQ ID NO: 268 - protein, 9 aa, Artificial Sequence
  Synthesized molecular recognition unit - heavy CDR1
GFFSSFTMG

SEQ ID NO: 269 - protein, 8 aa, Artificial Sequence
  Synthesized molecular recognition unit - heavy CDR1
GFTFSDHY

SEQ ID NO: 270 - protein, 10 aa, Artificial Sequence
  Synthesized molecular recognition unit - heavy CDR1
GFTFSHYTLS

SEQ ID NO: 271 - protein, 9 aa, Artificial Sequence
  Synthesized molecular recognition unit - heavy CDR1
GNFKNYGIT

SEQ ID NO: 272 - protein, 9 aa, Artificial Sequence
  Synthesized molecular recognition unit - heavy CDR1
GPFNLFAMG

SEQ ID NO: 273 - protein, 9 aa, Artificial Sequence
  Synthesized molecular recognition unit - heavy CDR1
GPFNLLAMG

SEQ ID NO: 274 - protein, 9 aa, Artificial Sequence
  Synthesized molecular recognition unit - heavy CDR1
GSFSGYAIN

SEQ ID NO: 275 - protein, 9 aa, Artificial Sequence
  Synthesized molecular recognition unit - heavy CDR1
GSFSGYAIS

SEQ ID NO: 276 - protein, 9 aa, Artificial Sequence
  Synthesized molecular recognition unit - heavy CDR1
GSFSGYYWH

SEQ ID NO: 277 - protein, 9 aa, Artificial Sequence
  Synthesized molecular recognition unit - heavy CDR1
GSFSGYYWS

SEQ ID NO: 278 - protein, 9 aa, Artificial Sequence
  Synthesized molecular recognition unit - heavy CDR1
GSFSNYAIS

SEQ ID NO: 279 - protein, 9 aa, Artificial Sequence
  Synthesized molecular recognition unit - heavy CDR1
GSFSTSVFG

SEQ ID NO: 280 - protein, 11 aa, Artificial Sequence
  Synthesized molecular recognition unit - heavy CDR1
GSISGNNYYWG

SEQ ID NO: 281 - protein, 11 aa, Artificial Sequence
  Synthesized molecular recognition unit - heavy CDR1
GSISGNNYYZG

SEQ ID NO: 282 - protein, 9 aa, Artificial Sequence
  Synthesized molecular recognition unit - heavy CDR1
GSISNYYWS

SEQ ID NO: 283 - protein, 11 aa, Artificial Sequence
  Synthesized molecular recognition unit - heavy CDR1
GSISSGGYSWS

SEQ ID NO: 284 - protein, 11 aa, Artificial Sequence
  Synthesized molecular recognition unit - heavy CDR1
GSISSGGYYWS

SEQ ID NO: 285 - protein, 11 aa, Artificial Sequence
  Synthesized molecular recognition unit - heavy CDR1
GSISSSSYYWG

SEQ ID NO: 286 - protein, 9 aa, Artificial Sequence
  Synthesized molecular recognition unit - heavy CDR1
GTFGNYGIN

SEQ ID NO: 287 - protein, 9 aa, Artificial Sequence
  Synthesized molecular recognition unit - heavy CDR1
GTFGSYAIT

SEQ ID NO: 288 - protein, 9 aa, Artificial Sequence
  Synthesized molecular recognition unit - heavy CDR1
GTFGSYAVG

SEQ ID NO: 289 - protein, 9 aa, Artificial Sequence
  Synthesized molecular recognition unit - heavy CDR1
GTFNRYAIT

SEQ ID NO: 290 - protein, 9 aa, Artificial Sequence
  Synthesized molecular recognition unit - heavy CDR1
GTFNRYGIS

SEQ ID NO: 291 - protein, 9 aa, Artificial Sequence
  Synthesized molecular recognition unit - heavy CDR1
GTFNSYAIA

SEQ ID NO: 292 - protein, 9 aa, Artificial Sequence
  Synthesized molecular recognition unit - heavy CDR1
GTFRSYAIN

SEQ ID NO: 293 - protein, 9 aa, Artificial Sequence
  Synthesized molecular recognition unit - heavy CDR1
GTFSSNVIS

SEQ ID NO: 294 - protein, 9 aa, Artificial Sequence
  Synthesized molecular recognition unit - heavy CDR1
GTFSSYAIN

SEQ ID NO: 295 - protein, 9 aa, Artificial Sequence
  Synthesized molecular recognition unit - heavy CDR1
GTFSSYAIS

SEQ ID NO: 296 - protein, 9 aa, Artificial Sequence
  Synthesized molecular recognition unit - heavy CDR1
GTFSSYTIS

SEQ ID NO: 297 - protein, 9 aa, Artificial Sequence
  Synthesized molecular recognition unit - heavy CDR1
GTFSSYVIS

SEQ ID NO: 298 - protein, 9 aa, Artificial Sequence
  Synthesized molecular recognition unit - heavy CDR1
GTFSTYAIS

SEQ ID NO: 299 - protein, 9 aa, Artificial Sequence
  Synthesized molecular recognition unit - heavy CDR1
GTFSTYAIS

SEQ ID NO: 300 - protein, 9 aa, Artificial Sequence
  Synthesized molecular recognition unit - heavy CDR1
GTFSTYAMG

SEQ ID NO: 301 - protein, 9 aa, Artificial Sequence
  Synthesized molecular recognition unit - heavy CDR1
GTFSZYAIS

SEQ ID NO: 302 - protein, 9 aa, Artificial Sequence
  Synthesized molecular recognition unit - heavy CDR1
GTFSZZTIS

SEQ ID NO: 303 - protein, 9 aa, Artificial Sequence
  Synthesized molecular recognition unit - heavy CDR1
GTFTNNFMH

SEQ ID NO: 304 - protein, 9 aa, Artificial Sequence
  Synthesized molecular recognition unit - heavy CDR1
GTFTRNSIS

SEQ ID NO: 305 - protein, 9 aa, Artificial Sequence
  Synthesized molecular recognition unit - heavy CDR1
GTFTSYAIS

SEQ ID NO: 306 - protein, 9 aa, Artificial Sequence
  Synthesized molecular recognition unit - heavy CDR1
GTFTSYPIS

SEQ ID NO: 307 - protein, 9 aa, Artificial Sequence
  Synthesized molecular recognition unit - heavy CDR1
GTFTYRYLH

SEQ ID NO: 308 - protein, 9 aa, Artificial Sequence
  Synthesized molecular recognition unit - heavy CDR1
GTLNNHTLS

SEQ ID NO: 309 - protein, 9 aa, Artificial Sequence
  Synthesized molecular recognition unit - heavy CDR1
GTSSTYAMG

SEQ ID NO: 310 - protein, 10 aa, Artificial Sequence
  Synthesized molecular recognition unit - heavy CDR1
HDFSSTYGVG

SEQ ID NO: 311 - protein, 10 aa, Artificial Sequence
  Synthesized molecular recognition unit - heavy CDR1
HDFSSTYGVG

SEQ ID NO: 312 - protein, 9 aa, Artificial Sequence
  Synthesized molecular recognition unit - heavy CDR1
HTFSGYHIH

SEQ ID NO: 313 - protein, 9 aa, Artificial Sequence
  Synthesized molecular recognition unit - heavy CDR1
IIFSPNDMG

SEQ ID NO: 314 - protein, 11 aa, Artificial Sequence
  Synthesized molecular recognition unit - heavy CDR1
IKSMFDMNFMG

SEQ ID NO: 315 - protein, 9 aa, Artificial Sequence
  Synthesized molecular recognition unit - heavy CDR1
ITFGFDSVG

SEQ ID NO: 316 - protein, 9 aa, Artificial Sequence
  Synthesized molecular recognition unit - heavy CDR1
ITFSFNSVG

SEQ ID NO: 317 - protein, 9 aa, Artificial Sequence
  Synthesized molecular recognition unit - heavy CDR1
LAFNGYTMG

SEQ ID NO: 318 - protein, 9 aa, Artificial Sequence
  Synthesized molecular recognition unit - heavy CDR1
LAIDDYYMV

SEQ ID NO: 319 - protein, 9 aa, Artificial Sequence
  Synthesized molecular recognition unit - heavy CDR1
LTFSDYTVG

SEQ ID NO: 320 - protein, 9 aa, Artificial Sequence
  Synthesized molecular recognition unit - heavy CDR1
LTFSIYAMH

SEQ ID NO: 321 - protein, 9 aa, Artificial Sequence
  Synthesized molecular recognition unit - heavy CDR1
LTFSTYGMG

SEQ ID NO: 322 - protein, 9 aa, Artificial Sequence
  Synthesized molecular recognition unit - heavy CDR1
LTIDDYYMV

SEQ ID NO: 323 - protein, 9 aa, Artificial Sequence
  Synthesized molecular recognition unit - heavy CDR1
LTIDDYYVV

SEQ ID NO: 324 - protein, 9 aa, Artificial Sequence
  Synthesized molecular recognition unit - heavy CDR1
LTVSTNFMS

SEQ ID NO: 325 - protein, 9 aa, Artificial Sequence
  Synthesized molecular recognition unit - heavy CDR1
NFFSNYPLG

SEQ ID NO: 326 - protein, 9 aa, Artificial Sequence
  Synthesized molecular recognition unit - heavy CDR1
NIFRIYAIA

SEQ ID NO: 327 - protein, 9 aa, Artificial Sequence
  Synthesized molecular recognition unit - heavy CDR1
QTFTAYAMG

SEQ ID NO: 328 - protein, 9 aa, Artificial Sequence
  Synthesized molecular recognition unit - heavy CDR1
RAFSNYAMG

SEQ ID NO: 329 - protein, 9 aa, Artificial Sequence
  Synthesized molecular recognition unit - heavy CDR1
RAFTDNVMA

SEQ ID NO: 330 - protein, 9 aa, Artificial Sequence
  Synthesized molecular recognition unit - heavy CDR1
RIFSSYAQA

SEQ ID NO: 331 - protein, 9 aa, Artificial Sequence
  Synthesized molecular recognition unit - heavy CDR1
RMFSNYAMG

SEQ ID NO: 332 - protein, 9 aa, Artificial Sequence
  Synthesized molecular recognition unit - heavy CDR1
RRFTTYGMG

SEQ ID NO: 333 - protein, 9 aa, Artificial Sequence
  Synthesized molecular recognition unit - heavy CDR1
RSFRTNALG

SEQ ID NO: 334 - protein, 9 aa, Artificial Sequence
  Synthesized molecular recognition unit - heavy CDR1
RSFSIYNTA

SEQ ID NO: 335 - protein, 9 aa, Artificial Sequence
  Synthesized molecular recognition unit - heavy CDR1
RSFSNYRVA

SEQ ID NO: 336 - protein, 9 aa, Artificial Sequence
  Synthesized molecular recognition unit - heavy CDR1
RSFSTYPMG

SEQ ID NO: 337 - protein, 9 aa, Artificial Sequence
  Synthesized molecular recognition unit - heavy CDR1
RTDGGYVMG

SEQ ID NO: 338 - protein, 9 aa, Artificial Sequence
  Synthesized molecular recognition unit - heavy CDR1
RTDGMQAMG

SEQ ID NO: 339 - protein, 9 aa, Artificial Sequence
  Synthesized molecular recognition unit - heavy CDR1
RTFGSYAMG

SEQ ID NO: 340 - protein, 9 aa, Artificial Sequence
  Synthesized molecular recognition unit - heavy CDR1
RTFGTWAMG

SEQ ID NO: 341 - protein, 9 aa, Artificial Sequence
  Synthesized molecular recognition unit - heavy CDR1
RTFNRHVMG

SEQ ID NO: 342 - protein, 9 aa, Artificial Sequence
  Synthesized molecular recognition unit - heavy CDR1
RTFRAYAMG

SEQ ID NO: 343 - protein, 9 aa, Artificial Sequence
  Synthesized molecular recognition unit - heavy CDR1
RTFSEYAMG

SEQ ID NO: 344 - protein, 9 aa, Artificial Sequence
  Synthesized molecular recognition unit - heavy CDR1
RTFSNYVMG

SEQ ID NO: 345 - protein, 9 aa, Artificial Sequence
  Synthesized molecular recognition unit - heavy CDR1
RTFSSAAMG

SEQ ID NO: 346 - protein, 9 aa, Artificial Sequence
  Synthesized molecular recognition unit - heavy CDR1
RTFSSFVMG

SEQ ID NO: 347 - protein, 9 aa, Artificial Sequence
  Synthesized molecular recognition unit - heavy CDR1
RTFSSYAMG

SEQ ID NO: 348 - protein, 9 aa, Artificial Sequence
  Synthesized molecular recognition unit - heavy CDR1
RTFSSYSLA

SEQ ID NO: 349 - protein, 9 aa, Artificial Sequence
  Synthesized molecular recognition unit - heavy CDR1
RTFSTYGMG

SEQ ID NO: 350 - protein, 9 aa, Artificial Sequence
  Synthesized molecular recognition unit - heavy CDR1
RTFSWYSMG

SEQ ID NO: 351 - protein, 9 aa, Artificial Sequence
  Synthesized molecular recognition unit - heavy CDR1
RTLSSYVVG

SEQ ID NO: 352 - protein, 9 aa, Artificial Sequence
  Synthesized molecular recognition unit - heavy CDR1
RTSDLYTMG

SEQ ID NO: 353 - protein, 9 aa, Artificial Sequence
  Synthesized molecular recognition unit - heavy CDR1
RTSSSYAMG

SEQ ID NO: 354 - protein, 9 aa, Artificial Sequence
  Synthesized molecular recognition unit - heavy CDR1
RVFSSYAQA

SEQ ID NO: 355 - protein, 9 aa, Artificial Sequence
  Synthesized molecular recognition unit - heavy CDR1
SAFSNYAMG

SEQ ID NO: 356 - protein, 9 aa, Artificial Sequence
  Synthesized molecular recognition unit - heavy CDR1
SIDSINAMA

SEQ ID NO: 357 - protein, 9 aa, Artificial Sequence
  Synthesized molecular recognition unit - heavy CDR1
SIFSINAMG

SEQ ID NO: 358 - protein, 9 aa, Artificial Sequence
  Synthesized molecular recognition unit - heavy CDR1
SIFSIYAMG

SEQ ID NO: 359 - protein, 9 aa, Artificial Sequence
  Synthesized molecular recognition unit - heavy CDR1
SIFSSNTIY

SEQ ID NO: 360 - protein, 9 aa, Artificial Sequence
  Synthesized molecular recognition unit - heavy CDR1
SLFRLNGMG

SEQ ID NO: 361 - protein, 9 aa, Artificial Sequence
  Synthesized molecular recognition unit - heavy CDR1
STFSNYAMG

SEQ ID NO: 362 - protein, 9 aa, Artificial Sequence
  Synthesized molecular recognition unit - heavy CDR1
STFSTYAMG

SEQ ID NO: 363 - protein, 9 aa, Artificial Sequence
  Synthesized molecular recognition unit - heavy CDR1
STFTNAWMS

SEQ ID NO: 364 - protein, 9 aa, Artificial Sequence
  Synthesized molecular recognition unit - heavy CDR1
SVVNFVVMG

SEQ ID NO: 365 - protein, 9 aa, Artificial Sequence
  Synthesized molecular recognition unit - heavy CDR1
TTLNKYAIS

SEQ ID NO: 366 - protein, 9 aa, Artificial Sequence
  Synthesized molecular recognition unit - heavy CDR1
VSFSGYAMH

SEQ ID NO: 367 - protein, 9 aa, Artificial Sequence
  Synthesized molecular recognition unit - heavy CDR1
YDFTTYGIH

SEQ ID NO: 368 - protein, 9 aa, Artificial Sequence
  Synthesized molecular recognition unit - heavy CDR1
YIFTDYYMH

SEQ ID NO: 369 - protein, 9 aa, Artificial Sequence
  Synthesized molecular recognition unit - heavy CDR1
YIFTGYYMH

SEQ ID NO: 370 - protein, 9 aa, Artificial Sequence
  Synthesized molecular recognition unit - heavy CDR1
YSFTNYAMH

SEQ ID NO: 371 - protein, 9 aa, Artificial Sequence
  Synthesized molecular recognition unit - heavy CDR1
YSFTTYGMN

SEQ ID NO: 372 - protein, 9 aa, Artificial Sequence
  Synthesized molecular recognition unit - heavy CDR1
YTFASYDIH

SEQ ID NO: 373 - protein, 9 aa, Artificial Sequence
  Synthesized molecular recognition unit - heavy CDR1
YTFASYGMH

SEQ ID NO: 374 - protein, 9 aa, Artificial Sequence
  Synthesized molecular recognition unit - heavy CDR1
YTFSGYYLH

SEQ ID NO: 375 - protein, 9 aa, Artificial Sequence
  Synthesized molecular recognition unit - heavy CDR1
YTFTDYHMH

SEQ ID NO: 376 - protein, 9 aa, Artificial Sequence
  Synthesized molecular recognition unit - heavy CDR1
YTFTDYYMH

SEQ ID NO: 377 - protein, 9 aa, Artificial Sequence
  Synthesized molecular recognition unit - heavy CDR1
YTFTGHYIH

SEQ ID NO: 378 - protein, 9 aa, Artificial Sequence
  Synthesized molecular recognition unit - heavy CDR1
YTFTGHYMH

SEQ ID NO: 379 - protein, 9 aa, Artificial Sequence
  Synthesized molecular recognition unit - heavy CDR1
YTFTGYYMH

SEQ ID NO: 380 - protein, 9 aa, Artificial Sequence
  Synthesized molecular recognition unit - heavy CDR1
YTFTHSYIH

SEQ ID NO: 381 - protein, 9 aa, Artificial Sequence
  Synthesized molecular recognition unit - heavy CDR1
YTFTKDYMH

SEQ ID NO: 382 - protein, 9 aa, Artificial Sequence
  Synthesized molecular recognition unit - heavy CDR1
YTFTNHFMH

SEQ ID NO: 383 - protein, 9 aa, Artificial Sequence
  Synthesized molecular recognition unit - heavy CDR1
YTFTNNFMH

SEQ ID NO: 384 - protein, 9 aa, Artificial Sequence
  Synthesized molecular recognition unit - heavy CDR1
YTFTNYCTR

SEQ ID NO: 385 - protein, 9 aa, Artificial Sequence
  Synthesized molecular recognition unit - heavy CDR1
YTFTRYAVH

SEQ ID NO: 386 - protein, 9 aa, Artificial Sequence
  Synthesized molecular recognition unit - heavy CDR1
YTFTSHWMH

SEQ ID NO: 387 - protein, 9 aa, Artificial Sequence
  Synthesized molecular recognition unit - heavy CDR1
YTFTSSAIH

SEQ ID NO: 388 - protein, 9 aa, Artificial Sequence
  Synthesized molecular recognition unit - heavy CDR1
YTFTSYAIS

SEQ ID NO: 389 - protein, 9 aa, Artificial Sequence
  Synthesized molecular recognition unit - heavy CDR1
YTFTSYAMH

SEQ ID NO: 390 - protein, 9 aa, Artificial Sequence
  Synthesized molecular recognition unit - heavy CDR1
YTFTSYDIN

SEQ ID NO: 391 - protein, 9 aa, Artificial Sequence
  Synthesized molecular recognition unit - heavy CDR1
YTFTSYGIS

SEQ ID NO: 392 - protein, 9 aa, Artificial Sequence
  Synthesized molecular recognition unit - heavy CDR1
YTFTSYYMH

SEQ ID NO: 393 - protein, 9 aa, Artificial Sequence
  Synthesized molecular recognition unit - heavy CDR1
YTFTTYFMH

SEQ ID NO: 394 - protein, 9 aa, Artificial Sequence
  Synthesized molecular recognition unit - heavy CDR1
YTFTYRYLH

SEQ ID NO: 395 - protein, 9 aa, Artificial Sequence
  Synthesized molecular recognition unit - heavy CDR1
YTFTYYAMH

SEQ ID NO: 396 - protein, 9 aa, Artificial Sequence
  Synthesized molecular recognition unit - heavy CDR1
YTITTYAIH

SEQ ID NO: 397 - protein, 9 aa, Artificial Sequence
  Synthesized molecular recognition unit - heavy CDR1
YTLSNYGIS

SEQ ID NO: 398 - protein, 9 aa, Artificial Sequence
  Synthesized molecular recognition unit - heavy CDR1
  misc_feature (9)..(9): Xaa can be any naturally occurring amino acid
YTLTTWYMX

SEQ ID NO: 399 - protein, 9 aa, Artificial Sequence
  Synthesized molecular recognition unit - heavy CDR1
YTVTSYAMH

SEQ ID NO: 400 - protein, 9 aa, Artificial Sequence
  Synthesized molecular recognition unit - heavy CDR1
YZFZZZYMH

SEQ ID NO: 401 - protein, 9 aa, Artificial Sequence
  Synthesized molecular recognition unit - heavy CDR1
ZSVSSNYMS

SEQ ID NO: 402 - protein, 9 aa, Artificial Sequence
  Synthesized molecular recognition unit - heavy CDR1
ZTFSZYDMH

SEQ ID NO: 403 - protein, 9 aa, Artificial Sequence
  Synthesized molecular recognition unit - heavy CDR1
ZZZTDYYZQ

SEQ ID NO: 404 - protein, 17 aa, Artificial Sequence
  Synthesized molecular recognition unit - heavy CDR2
AAIGYKVKWNGERTYYL

SEQ ID NO: 405 - protein, 13 aa, Artificial Sequence
  Synthesized molecular recognition unit - heavy CDR2
AAINRSGGSTYYA

SEQ ID NO: 406 - protein, 13 aa, Artificial Sequence
  Synthesized molecular recognition unit - heavy CDR2
AAINWSGDSAYYA

SEQ ID NO: 407 - protein, 13 aa, Artificial Sequence
  Synthesized molecular recognition unit - heavy CDR2
AAINWSGRSTVYA

SEQ ID NO: 408 - protein, 13 aa, Artificial Sequence
  Synthesized molecular recognition unit - heavy CDR2
AAISGSGENTYYA

SEQ ID NO: 409 - protein, 13 aa, Artificial Sequence
  Synthesized molecular recognition unit - heavy CDR2
AAISRNGVYTRFA

SEQ ID NO: 410 - protein, 13 aa, Artificial Sequence
  Synthesized molecular recognition unit - heavy CDR2
AAISSGGSGTYYS

SEQ ID NO: 411 - protein, 13 aa, Artificial Sequence
  Synthesized molecular recognition unit - heavy CDR2
AAISWGGGSTFYS

SEQ ID NO: 412 - protein, 12 aa, Artificial Sequence
  Synthesized molecular recognition unit - heavy CDR2
AAISWMSNTYYA

SEQ ID NO: 413 - protein, 11 aa, Artificial Sequence
  Synthesized molecular recognition unit - heavy CDR2
AAISWRGTNIA

SEQ ID NO: 414 - protein, 12 aa, Artificial Sequence
  Synthesized molecular recognition unit - heavy CDR2
AAISWSDNTYYA

SEQ ID NO: 415 - protein, 13 aa, Artificial Sequence
  Synthesized molecular recognition unit - heavy CDR2
AAISWSGDSTYYA

SEQ ID NO: 416 - protein, 13 aa, Artificial Sequence
  Synthesized molecular recognition unit - heavy CDR2
AAISWSGDSTYYL

SEQ ID NO: 417 - protein, 13 aa, Artificial Sequence
  Synthesized molecular recognition unit - heavy CDR2
AAISWSGGSTHYA

SEQ ID NO: 418 - protein, 13 aa, Artificial Sequence
  Synthesized molecular recognition unit - heavy CDR2
AAISWSGGSTYYA

SEQ ID NO: 419 - protein, 13 aa, Artificial Sequence
  Synthesized molecular recognition unit - heavy CDR2
AAISWSGRSTYYA

SEQ ID NO: 420 - protein, 13 aa, Artificial Sequence
  Synthesized molecular recognition unit - heavy CDR2
AAISWSGSATHYA

SEQ ID NO: 421 - protein, 13 aa, Artificial Sequence
  Synthesized molecular recognition unit - heavy CDR2
AAISWSGSTAYYA

SEQ ID NO: 422 - protein, 13 aa, Artificial Sequence
  Synthesized molecular recognition unit - heavy CDR2
AAISWTGGSTYYA

SEQ ID NO: 423 - protein, 13 aa, Artificial Sequence
  Synthesized molecular recognition unit - heavy CDR2
AAISYDESNKFYA

SEQ ID NO: 424 - protein, 13 aa, Artificial Sequence
  Synthesized molecular recognition unit - heavy CDR2
AAISYNGFSTYYS

SEQ ID NO: 425 - protein, 12 aa, Artificial Sequence
  Synthesized molecular recognition unit - heavy CDR2
AAITSGGSTNYA

SEQ ID NO: 426 - protein, 13 aa, Artificial Sequence
  Synthesized molecular recognition unit - heavy CDR2
AAITWSGARTYYA

SEQ ID NO: 427 - protein, 12 aa, Artificial Sequence
  Synthesized molecular recognition unit - heavy CDR2
AALTGQRTTNYA

SEQ ID NO: 428 - protein, 12 aa, Artificial Sequence
  Synthesized molecular recognition unit - heavy CDR2
AALTSGGITYHA

SEQ ID NO: 429 - protein, 13 aa, Artificial Sequence
  Synthesized molecular recognition unit - heavy CDR2
AAVNWRGDGTYYS

SEQ ID NO: 430 - protein, 13 aa, Artificial Sequence
  Synthesized molecular recognition unit - heavy CDR2
AAVNWSGGSTYYA

SEQ ID NO: 431 - protein, 13 aa, Artificial Sequence
  Synthesized molecular recognition unit - heavy CDR2
AAVSASGANTYYA

SEQ ID NO: 432 - protein, 13 aa, Artificial Sequence
  Synthesized molecular recognition unit - heavy CDR2
AAVSASGGYTWYA

SEQ ID NO: 433 - protein, 13 aa, Artificial Sequence
  Synthesized molecular recognition unit - heavy CDR2
AAVSWSGVSTYYP

SEQ ID NO: 434 - protein, 13 aa, Artificial Sequence
  Synthesized molecular recognition unit - heavy CDR2
AAVTASGGYAWYA

SEQ ID NO: 435 - protein, 13 aa, Artificial Sequence
  Synthesized molecular recognition unit - heavy CDR2
AAVTWRAGSTYYA

SEQ ID NO: 436 - protein, 13 aa, Artificial Sequence
  Synthesized molecular recognition unit - heavy CDR2
AAVTWRSGSTYYA

SEQ ID NO: 437 - protein, 12 aa, Artificial Sequence
  Synthesized molecular recognition unit - heavy CDR2
ADITSGGSTNYA

SEQ ID NO: 438 - protein, 12 aa, Artificial Sequence
  Synthesized molecular recognition unit - heavy CDR2
AFITRGGTTRYG

SEQ ID NO: 439 - protein, 12 aa, Artificial Sequence
  Synthesized molecular recognition unit - heavy CDR2
AGIASDSTTFYA

SEQ ID NO: 440 - protein, 13 aa, Artificial Sequence
  Synthesized molecular recognition unit - heavy CDR2
AGIGWDSTNIGYA

SEQ ID NO: 441 - protein, 13 aa, Artificial Sequence
  Synthesized molecular recognition unit - heavy CDR2
AGINWNGGSVVYA

SEQ ID NO: 442 - protein, 13 aa, Artificial Sequence
  Synthesized molecular recognition unit - heavy CDR2
AGISASGGSTYYA

SEQ ID NO: 443 - protein, 13 aa, Artificial Sequence
  Synthesized molecular recognition unit - heavy CDR2
AGISGGGGSTDYA

SEQ ID NO: 444 - protein, 13 aa, Artificial Sequence
  Synthesized molecular recognition unit - heavy CDR2
AGISGSGKTTFYA

SEQ ID NO: 445 - protein, 13 aa, Artificial Sequence
  Synthesized molecular recognition unit - heavy CDR2
AGISRTGGNTGYA

SEQ ID NO: 446 - protein, 13 aa, Artificial Sequence
  Synthesized molecular recognition unit - heavy CDR2
AGISWNSGTIDYA

SEQ ID NO: 447 - protein, 13 aa, Artificial Sequence
  Synthesized molecular recognition unit - heavy CDR2
AGVSIDANKKYYA

SEQ ID NO: 448 - protein, 13 aa, Artificial Sequence
  Synthesized molecular recognition unit - heavy CDR2
AIVSYDGTYKYYS

SEQ ID NO: 449 - protein, 13 aa, Artificial Sequence
  Synthesized molecular recognition unit - heavy CDR2
ALISLSGASTYYA

SEQ ID NO: 450 - protein, 12 aa, Artificial Sequence
  Synthesized molecular recognition unit - heavy CDR2
ALISSGGSTSYA

SEQ ID NO: 451 - protein, 13 aa, Artificial Sequence
  Synthesized molecular recognition unit - heavy CDR2
ALISSNGDHKYYT

SEQ ID NO: 452 - protein, 13 aa, Artificial Sequence
  Synthesized molecular recognition unit - heavy CDR2
ALISYDGGNKYYA

SEQ ID NO: 453 - protein, 13 aa, Artificial Sequence
  Synthesized molecular recognition unit - heavy CDR2
ALISYDGGTKYYA

SEQ ID NO: 454 - protein, 13 aa, Artificial Sequence
  Synthesized molecular recognition unit - heavy CDR2
ALISYDGSHTYYA

SEQ ID NO: 455 - protein, 12 aa, Artificial Sequence
  Synthesized molecular recognition unit - heavy CDR2
ALITTSGNTNYA

SEQ ID NO: 456 - protein, 13 aa, Artificial Sequence
  Synthesized molecular recognition unit - heavy CDR2
ALMSPDGTIIYYA

SEQ ID NO: 457 - protein, 13 aa, Artificial Sequence
  Synthesized molecular recognition unit - heavy CDR2
ALTSYDGSKKFYA

SEQ ID NO: 458 - protein, 13 aa, Artificial Sequence
  Synthesized molecular recognition unit - heavy CDR2
ALVGYDGSQQFYG

SEQ ID NO: 459 - protein, 13 aa, Artificial Sequence
  Synthesized molecular recognition unit - heavy CDR2
ANIKQDGSEKYYV

SEQ ID NO: 460 - protein, 13 aa, Artificial Sequence
  Synthesized molecular recognition unit - heavy CDR2
AQISWTGGSTDYA

SEQ ID NO: 461 - protein, 12 aa, Artificial Sequence
  Synthesized molecular recognition unit - heavy CDR2
ASIPSDGTTFYA

SEQ ID NO: 462 - protein, 13 aa, Artificial Sequence
  Synthesized molecular recognition unit - heavy CDR2
ASITWNGRYTYYA

SEQ ID NO: 463 - protein, 13 aa, Artificial Sequence
  Synthesized molecular recognition unit - heavy CDR2
ASIWFDGSNQDYA

SEQ ID NO: 464 - protein, 13 aa, Artificial Sequence
  Synthesized molecular recognition unit - heavy CDR2
ASSTGGGVFENYA

SEQ ID NO: 465 - protein, 12 aa, Artificial Sequence
  Synthesized molecular recognition unit - heavy CDR2
ATIQSGGRTNYA

SEQ ID NO: 466 - protein, 13 aa, Artificial Sequence
  Synthesized molecular recognition unit - heavy CDR2
ATISGGGGSTFDD

SEQ ID NO: 467 - protein, 12 aa, Artificial Sequence
  Synthesized molecular recognition unit - heavy CDR2
ATISTRGTTHYA

SEQ ID NO: 468 - protein, 11 aa, Artificial Sequence
  Synthesized molecular recognition unit - heavy CDR2
ATISWGGTNIA

SEQ ID NO: 469 - protein, 13 aa, Artificial Sequence
  Synthesized molecular recognition unit - heavy CDR2
ATVTWRTGTTYYA

SEQ ID NO: 470 - protein, 12 aa, Artificial Sequence
  Synthesized molecular recognition unit - heavy CDR2
AVFIAGYGAYYA

SEQ ID NO: 471 - protein, 12 aa, Artificial Sequence
  Synthesized molecular recognition unit - heavy CDR2
AVFNAGYRAYYA

SEQ ID NO: 472 - protein, 13 aa, Artificial Sequence
  Synthesized molecular recognition unit - heavy CDR2
AVISRSGGNTYYT

SEQ ID NO: 473 - protein, 13 aa, Artificial Sequence
  Synthesized molecular recognition unit - heavy CDR2
AVISSDGNNKYYT

SEQ ID NO: 474 - protein, 13 aa, Artificial Sequence
  Synthesized molecular recognition unit - heavy CDR2
AVISYDGSNEYYA

SEQ ID NO: 475 - protein, 13 aa, Artificial Sequence
  Synthesized molecular recognition unit - heavy CDR2
AVISYDGSNKYYA

SEQ ID NO: 476 - protein, 13 aa, Artificial Sequence
  Synthesized molecular recognition unit - heavy CDR2
AVISYDGSNRZYA

SEQ ID NO: 477 - protein, 13 aa, Artificial Sequence
  Synthesized molecular recognition unit - heavy CDR2
AVITSGGTFKYYA

SEQ ID NO: 478 - protein, 12 aa, Artificial Sequence
  Synthesized molecular recognition unit - heavy CDR2
AVMYSGGTTYYA

SEQ ID NO: 479 - protein, 12 aa, Artificial Sequence
  Synthesized molecular recognition unit - heavy CDR2
AVSWSVGMTYYA

SEQ ID NO: 480 - protein, 13 aa, Artificial Sequence
  Synthesized molecular recognition unit - heavy CDR2
AVTWYDGSNKYYA

SEQ ID NO: 481 - protein, 12 aa, Artificial Sequence
  Synthesized molecular recognition unit - heavy CDR2
AVVATGGATNYA

SEQ ID NO: 482 - protein, 13 aa, Artificial Sequence
  Synthesized molecular recognition unit - heavy CDR2
AYINSGSSEMNYA

SEQ ID NO: 483 - protein, 13 aa, Artificial Sequence
  Synthesized molecular recognition unit - heavy CDR2
AYINSRGSLMYYA

SEQ ID NO: 484 - protein, 13 aa, Artificial Sequence
  Synthesized molecular recognition unit - heavy CDR2
GAISRTGSGTFYA

SEQ ID NO: 485 - protein, 13 aa, Artificial Sequence
  Synthesized molecular recognition unit - heavy CDR2
GAITWSLGIAFYA

SEQ ID NO: 486 - protein, 13 aa, Artificial Sequence
  Synthesized molecular recognition unit - heavy CDR2
GAITWSLGSAFYA

SEQ ID NO: 487 - protein, 12 aa, Artificial Sequence
  Synthesized molecular recognition unit - heavy CDR2
GEIDHTGSTNYE

SEQ ID NO: 488 - protein, 12 aa, Artificial Sequence
  Synthesized molecular recognition unit - heavy CDR2
GEIDRSGDTNYN

SEQ ID NO: 489 - protein, 12 aa, Artificial Sequence
  Synthesized molecular recognition unit - heavy CDR2
GEINHSGSTNYN

SEQ ID NO: 490 - protein, 15 aa, Artificial Sequence
  Synthesized molecular recognition unit - heavy CDR2
GFIRSKAYGGTTEYA

SEQ ID NO: 491 - protein, 15 aa, Artificial Sequence
  Synthesized molecular recognition unit - heavy CDR2
GFIRSKDYGGTTEYA

SEQ ID NO: 492 - protein, 13 aa, Artificial Sequence
  Synthesized molecular recognition unit - heavy CDR2
GGFDPEDGETIYA

SEQ ID NO: 493 - protein, 13 aa, Artificial Sequence
  Synthesized molecular recognition unit - heavy CDR2
GGIFPIFGTANYA

SEQ ID NO: 494 - protein, 13 aa, Artificial Sequence
  Synthesized molecular recognition unit - heavy CDR2
GGIFPIYGISTYA

SEQ ID NO: 495 - protein, 13 aa, Artificial Sequence
  Synthesized molecular recognition unit - heavy CDR2
GGIIPFFNTVNYA

SEQ ID NO: 496 - protein, 13 aa, Artificial Sequence
  Synthesized molecular recognition unit - heavy CDR2
GGIIPIFGIANYA

SEQ ID NO: 497 - protein, 13 aa, Artificial Sequence
  Synthesized molecular recognition unit - heavy CDR2
GGIIPIFGTAKYA

SEQ ID NO: 498 - protein, 13 aa, Artificial Sequence
  Synthesized molecular recognition unit - heavy CDR2
GGIIPIFGTANHA

SEQ ID NO: 499 - protein, 13 aa, Artificial Sequence
  Synthesized molecular recognition unit - heavy CDR2
GGIIPIFGTANYA

SEQ ID NO: 500 - protein, 13 aa, Artificial Sequence
  Synthesized molecular recognition unit - heavy CDR2
GGIIPIFGTAZYA

SEQ ID NO: 501 - protein, 13 aa, Artificial Sequence
  Synthesized molecular recognition unit - heavy CDR2
GGIIPIFGTGNYA

SEQ ID NO: 502 - protein, 13 aa, Artificial Sequence
  Synthesized molecular recognition unit - heavy CDR2
GGIIPIFGTPHYA

SEQ ID NO: 503 - protein, 13 aa, Artificial Sequence
  Synthesized molecular recognition unit - heavy CDR2
GGIIPIFGTTNYA

SEQ ID NO: 504 - protein, 13 aa, Artificial Sequence
  Synthesized molecular recognition unit - heavy CDR2
GGIIPILGIANYA

SEQ ID NO: 505 - protein, 13 aa, Artificial Sequence
  Synthesized molecular recognition unit - heavy CDR2
GGIIPISGKTDYA

SEQ ID NO: 506 - protein, 13 aa, Artificial Sequence
  Synthesized molecular recognition unit - heavy CDR2
GGIIPLFGTANYA

SEQ ID NO: 507 - protein, 13 aa, Artificial Sequence
  Synthesized molecular recognition unit - heavy CDR2
GGIIPLFGTTDYA

SEQ ID NO: 508 - protein, 13 aa, Artificial Sequence
  Synthesized molecular recognition unit - heavy CDR2
GGIIPRLGATDYA

SEQ ID NO: 509 - protein, 13 aa, Artificial Sequence
  Synthesized molecular recognition unit - heavy CDR2
GGILPIYGTTKYA

SEQ ID NO: 510 - protein, 13 aa, Artificial Sequence
  Synthesized molecular recognition unit - heavy CDR2
GGMNZNRGNTGYA

SEQ ID NO: 511 - protein, 13 aa, Artificial Sequence
  Synthesized molecular recognition unit - heavy CDR2
GGVIPAFGATDYS

SEQ ID NO: 512 - protein, 13 aa, Artificial Sequence
  Synthesized molecular recognition unit - heavy CDR2
GIINPSGGRTTYA

SEQ ID NO: 513 - protein, 13 aa, Artificial Sequence
  Synthesized molecular recognition unit - heavy CDR2
GIINPSGGSTSYA

SEQ ID NO: 514 - protein, 13 aa, Artificial Sequence
  Synthesized molecular recognition unit - heavy CDR2
GIINPSSGRTDYA

SEQ ID NO: 515 - protein, 13 aa, Artificial Sequence
  Synthesized molecular recognition unit - heavy CDR2
GIISPGGGRTIYA

SEQ ID NO: 516 - protein, 13 aa, Artificial Sequence
  Synthesized molecular recognition unit - heavy CDR2
GIISPSGGSTSYA

SEQ ID NO: 517 - protein, 13 aa, Artificial Sequence
  Synthesized molecular recognition unit - heavy CDR2
GIIZPGGGRTIYA

SEQ ID NO: 518 - protein, 13 aa, Artificial Sequence
  Synthesized molecular recognition unit - heavy CDR2
GLISRNAGNTLYA

SEQ ID NO: 519 - protein, 13 aa, Artificial Sequence
  Synthesized molecular recognition unit - heavy CDR2
GLVCPSDGSTSYA

SEQ ID NO: 520 - protein, 13 aa, Artificial Sequence
  Synthesized molecular recognition unit - heavy CDR2
GLVDPEDGETIYA

SEQ ID NO: 521 - protein, 13 aa, Artificial Sequence
  Synthesized molecular recognition unit - heavy CDR2
GMIIPFLGITNYA

SEQ ID NO: 522 - protein, 13 aa, Artificial Sequence
  Synthesized molecular recognition unit - heavy CDR2
GMINPIGGSINYA

SEQ ID NO: 523 - protein, 13 aa, Artificial Sequence
  Synthesized molecular recognition unit - heavy CDR2
GMINPSGGSTTYA

SEQ ID NO: 524 - protein, 14 aa, Artificial Sequence
  Synthesized molecular recognition unit - heavy CDR2
GRAYYKSRWYYDYA

SEQ ID NO: 525 - protein, 13 aa, Artificial Sequence
  Synthesized molecular recognition unit - heavy CDR2
GRIIPALGTANYA

SEQ ID NO: 526 - protein, 13 aa, Artificial Sequence
  Synthesized molecular recognition unit - heavy CDR2
GRIIPIFGTANYA

SEQ ID NO: 527 - protein, 13 aa, Artificial Sequence
  Synthesized molecular recognition unit - heavy CDR2
GRIIPIFGTAZYA

SEQ ID NO: 528 - protein, 13 aa, Artificial Sequence
  Synthesized molecular recognition unit - heavy CDR2
GRIIPIFGTVNYA

SEQ ID NO: 529 - protein, 13 aa, Artificial Sequence
  Synthesized molecular recognition unit - heavy CDR2
GRIIPILGIANYA

SEQ ID NO: 530 - protein, 13 aa, Artificial Sequence
  Synthesized molecular recognition unit - heavy CDR2
GRIIPILGSANYA

SEQ ID NO: 531 - protein, 13 aa, Artificial Sequence
  Synthesized molecular recognition unit - heavy CDR2
GRIIPILGTPNYA

SEQ ID NO: 532 - protein, 13 aa, Artificial Sequence
  Synthesized molecular recognition unit - heavy CDR2
GRIIPLFGTTNYA

SEQ ID NO: 533 - protein, 13 aa, Artificial Sequence
  Synthesized molecular recognition unit - heavy CDR2
GRIIPTVGTANYA

SEQ ID NO: 534 - protein, 13 aa, Artificial Sequence
  Synthesized molecular recognition unit - heavy CDR2
GRIIPVLGTANYA

SEQ ID NO: 535 - protein, 15 aa, Artificial Sequence
  Synthesized molecular recognition unit - heavy CDR2
GRIKSKANGGTTDYA

SEQ ID NO: 536 - protein, 15 aa, Artificial Sequence
  Synthesized molecular recognition unit - heavy CDR2
GRIKSKAYGGTTEYA

SEQ ID NO: 537 - protein, 13 aa, Artificial Sequence
  Synthesized molecular recognition unit - heavy CDR2
GRINPNSGGTNYA

SEQ ID NO: 538 - protein, 13 aa, Artificial Sequence
  Synthesized molecular recognition unit - heavy CDR2
GRISAYNGYKSYA

SEQ ID NO: 539 - protein, 13 aa, Artificial Sequence
  Synthesized molecular recognition unit - heavy CDR2
GRITPVVGVTNYA

SEQ ID NO: 540 - protein, 13 aa, Artificial Sequence
  Synthesized molecular recognition unit - heavy CDR2
GRIVPAIGFTQYA

SEQ ID NO: 541 - protein, 13 aa, Artificial Sequence
  Synthesized molecular recognition unit - heavy CDR2
GRIVPIVDVVKYA

SEQ ID NO: 542 - protein, 14 aa, Artificial Sequence
  Synthesized molecular recognition unit - heavy CDR2
GRTYYRSKWYNDYA

SEQ ID NO: 543 - protein, 14 aa, Artificial Sequence
  Synthesized molecular recognition unit - heavy CDR2
GRTYYRSKWYSDYA

SEQ ID NO: 544 - protein, 14 aa, Artificial Sequence
  Synthesized molecular recognition unit - heavy CDR2
GRTYYRSKYYNGYA

SEQ ID NO: 545 - protein, 13 aa, Artificial Sequence
  Synthesized molecular recognition unit - heavy CDR2
GRVIPILGVTNYA

SEQ ID NO: 546 - protein, 12 aa, Artificial Sequence
  Synthesized molecular recognition unit - heavy CDR2
GSIYFTGGTYYN

SEQ ID NO: 547 - protein, 12 aa, Artificial Sequence
  Synthesized molecular recognition unit - heavy CDR2
GSIYHSGSTYYN

SEQ ID NO: 548 - protein, 12 aa, Artificial Sequence
  Synthesized molecular recognition unit - heavy CDR2
GSIYYTGNTYYN

SEQ ID NO: 549 - protein, 13 aa, Artificial Sequence
  Synthesized molecular recognition unit - heavy CDR2
GTVTPILGTANYA

SEQ ID NO: 550 - protein, 13 aa, Artificial Sequence
  Synthesized molecular recognition unit - heavy CDR2
GVIDPSTGGTNYA

SEQ ID NO: 551 - protein, 13 aa, Artificial Sequence
  Synthesized molecular recognition unit - heavy CDR2
GVIFPVYPTPDYA

SEQ ID NO: 552 - protein, 13 aa, Artificial Sequence
  Synthesized molecular recognition unit - heavy CDR2
GVINPGSGGTSYN

SEQ ID NO: 553 - protein, 13 aa, Artificial Sequence
  Synthesized molecular recognition unit - heavy CDR2
GVISKDGDNKYYA

SEQ ID NO: 554 - protein, 13 aa, Artificial Sequence
  Synthesized molecular recognition unit - heavy CDR2
GWIGPHNGNTNYA

SEQ ID NO: 555 - protein, 13 aa, Artificial Sequence
  Synthesized molecular recognition unit - heavy CDR2
GWINADTGDTAYS

SEQ ID NO: 556 - protein, 13 aa, Artificial Sequence
  Synthesized molecular recognition unit - heavy CDR2
GWINAGNGNTKYA

SEQ ID NO: 557 - protein, 13 aa, Artificial Sequence
  Synthesized molecular recognition unit - heavy CDR2
GWINAGNGNTKYS

SEQ ID NO: 558 - protein, 13 aa, Artificial Sequence
  Synthesized molecular recognition unit - heavy CDR2
GWINAGNGNTTYA

SEQ ID NO: 559 - protein, 13 aa, Artificial Sequence
  Synthesized molecular recognition unit - heavy CDR2
GWINAKSGGTFYA

SEQ ID NO: 560 - protein, 13 aa, Artificial Sequence
  Synthesized molecular recognition unit - heavy CDR2
GWINPKSGGTNYA

SEQ ID NO: 561 - protein, 13 aa, Artificial Sequence
  Synthesized molecular recognition unit - heavy CDR2
GWINPNSGDTKFA

SEQ ID NO: 562 - protein, 13 aa, Artificial Sequence
  Synthesized molecular recognition unit - heavy CDR2
GWINPNSGGTIYA

SEQ ID NO: 563 - protein, 13 aa, Artificial Sequence
  Synthesized molecular recognition unit - heavy CDR2
GWINPNSGGTKYA

SEQ ID NO: 564 - protein, 13 aa, Artificial Sequence
  Synthesized molecular recognition unit - heavy CDR2
GWINPNSGGTNYA

SEQ ID NO: 565 - protein, 13 aa, Artificial Sequence
  Synthesized molecular recognition unit - heavy CDR2
GWINSGNGNTKYS

SEQ ID NO: 566 - protein, 13 aa, Artificial Sequence
  Synthesized molecular recognition unit - heavy CDR2
GWINTYNGNTIYA

SEQ ID NO: 567 - protein, 13 aa, Artificial Sequence
  Synthesized molecular recognition unit - heavy CDR2
GWINTYNGNTNYP

SEQ ID NO: 568 - protein, 13 aa, Artificial Sequence
  Synthesized molecular recognition unit - heavy CDR2
GWISAYNGDTKYA

SEQ ID NO: 569 - protein, 13 aa, Artificial Sequence
  Synthesized molecular recognition unit - heavy CDR2
GWISAYNGHTNYA

SEQ ID NO: 570 - protein, 13 aa, Artificial Sequence
  Synthesized molecular recognition unit - heavy CDR2
GWISAYNGNTNYA

SEQ ID NO: 571 - protein, 13 aa, Artificial Sequence
  Synthesized molecular recognition unit - heavy CDR2
GWISPNRGGTNYA

SEQ ID NO: 572 - protein, 13 aa, Artificial Sequence
  Synthesized molecular recognition unit - heavy CDR2
GWISPYNGNTKYA

SEQ ID NO: 573 - protein, 13 aa, Artificial Sequence
  Synthesized molecular recognition unit - heavy CDR2
GWISPYNGNTNYA

SEQ ID NO: 574 - protein, 13 aa, Artificial Sequence
  Synthesized molecular recognition unit - heavy CDR2
GWISPYNGYTKYA

SEQ ID NO: 575 - protein, 13 aa, Artificial Sequence
  Synthesized molecular recognition unit - heavy CDR2
GWISSFNGNTKYA

SEQ ID NO: 576 - protein, 13 aa, Artificial Sequence
  Synthesized molecular recognition unit - heavy CDR2
GWISTFNDNTNYA

SEQ ID NO: 577 - protein, 13 aa, Artificial Sequence
  Synthesized molecular recognition unit - heavy CDR2
GWISTYNGATNYA

SEQ ID NO: 578 - protein, 13 aa, Artificial Sequence
  Synthesized molecular recognition unit - heavy CDR2
GWIYPNSGGTKYA

SEQ ID NO: 579 - protein, 13 aa, Artificial Sequence
  Synthesized molecular recognition unit - heavy CDR2
GWMNPDSGKTGYA

SEQ ID NO: 580 - protein, 13 aa, Artificial Sequence
  Synthesized molecular recognition unit - heavy CDR2
GWMNPISGNTGYA

SEQ ID NO: 581 - protein, 13 aa, Artificial Sequence
  Synthesized molecular recognition unit - heavy CDR2
GWMNPNNGNTTYA

SEQ ID NO: 582 - protein, 13 aa, Artificial Sequence
  Synthesized molecular recognition unit - heavy CDR2
GWMNPNSGNTAYA

SEQ ID NO: 583 - protein, 13 aa, Artificial Sequence
  Synthesized molecular recognition unit - heavy CDR2
GWMNPNSGNTGYA

SEQ ID NO: 584 - protein, 13 aa, Artificial Sequence
  Synthesized molecular recognition unit - heavy CDR2
GWMSPNSGNAGFA

SEQ ID NO: 585 - protein, 13 aa, Artificial Sequence
  Synthesized molecular recognition unit - heavy CDR2
GWMSPSSGNAGYA

SEQ ID NO: 586 - protein, 13 aa, Artificial Sequence
  Synthesized molecular recognition unit - heavy CDR2
GWVNPTTGNTGYA

SEQ ID NO: 587 - protein, 13 aa, Artificial Sequence
  Synthesized molecular recognition unit - heavy CDR2
GWVSPNTGNTVYA

SEQ ID NO: 588 - protein, 13 aa, Artificial Sequence
  Synthesized molecular recognition unit - heavy CDR2
GWVSPSSGNTAYA

SEQ ID NO: 589 - protein, 12 aa, Artificial Sequence
  Synthesized molecular recognition unit - heavy CDR2
GYIYYSGSTYYN

SEQ ID NO: 590 - protein, 12 aa, Artificial Sequence
  Synthesized molecular recognition unit - heavy CDR2
PRIPSDSTTFYA

SEQ ID NO: 591 - protein, 12 aa, Artificial Sequence
  Synthesized molecular recognition unit - heavy CDR2
SAIDGAGRTYYT

SEQ ID NO: 592 - protein, 13 aa, Artificial Sequence
  Synthesized molecular recognition unit - heavy CDR2
SAIDGSGGSTYYA

SEQ ID NO: 593 - protein, 12 aa, Artificial Sequence
  Synthesized molecular recognition unit - heavy CDR2
SAIGAGGGTYYA

SEQ ID NO: 594 - protein, 12 aa, Artificial Sequence
  Synthesized molecular recognition unit - heavy CDR2
SAIGTGGDTYYA

SEQ ID NO: 595 - protein, 12 aa, Artificial Sequence
  Synthesized molecular recognition unit - heavy CDR2
SAIGTGGGTYYA

SEQ ID NO: 596 - protein, 13 aa, Artificial Sequence
  Synthesized molecular recognition unit - heavy CDR2
SAISASGDSTFYA

SEQ ID NO: 597 - protein, 13 aa, Artificial Sequence
  Synthesized molecular recognition unit - heavy CDR2
SAISGDGALTYYA

SEQ ID NO: 598 - protein, 13 aa, Artificial Sequence
  Synthesized molecular recognition unit - heavy CDR2
SAISGSGATTTYA

SEQ ID NO: 599 - protein, 12 aa, Artificial Sequence
  Synthesized molecular recognition unit - heavy CDR2
SAISGSGFTYYA

SEQ ID NO: 600 - protein, 13 aa, Artificial Sequence
  Synthesized molecular recognition unit - heavy CDR2
SAISGSGGSTYYA

SEQ ID NO: 601 - protein, 13 aa, Artificial Sequence
  Synthesized molecular recognition unit - heavy CDR2
SAISNSGGSTYYA

SEQ ID NO: 602 - protein, 13 aa, Artificial Sequence
  Synthesized molecular recognition unit - heavy CDR2
SAISVSGGTTFYA

SEQ ID NO: 603 - protein, 13 aa, Artificial Sequence
  Synthesized molecular recognition unit - heavy CDR2
SAISWSGGSTYYA

SEQ ID NO: 604 - protein, 13 aa, Artificial Sequence
  Synthesized molecular recognition unit - heavy CDR2
SAVSGNGGGTFYA

SEQ ID NO: 605 - protein, 12 aa, Artificial Sequence
  Synthesized molecular recognition unit - heavy CDR2
SGIGVGGGTYYA

SEQ ID NO: 606 - protein, 13 aa, Artificial Sequence
  Synthesized molecular recognition unit - heavy CDR2
SGINWNGGSTGYA

SEQ ID NO: 607 - protein, 13 aa, Artificial Sequence
  Synthesized molecular recognition unit - heavy CDR2
SGINWNSAKIGYV

SEQ ID NO: 608 - protein, 13 aa, Artificial Sequence
  Synthesized molecular recognition unit - heavy CDR2
SGISGSGGSTYYA

SEQ ID NO: 609 - protein, 13 aa, Artificial Sequence
  Synthesized molecular recognition unit - heavy CDR2
SGISGSGGTTYYA

SEQ ID NO: 610 - protein, 13 aa, Artificial Sequence
  Synthesized molecular recognition unit - heavy CDR2
SGISGSGRSTYYA

SEQ ID NO: 611 - protein, 13 aa, Artificial Sequence
  Synthesized molecular recognition unit - heavy CDR2
SGISGSGSSTYYA

SEQ ID NO: 612 - protein, 13 aa, Artificial Sequence
  Synthesized molecular recognition unit - heavy CDR2
SGISGSGTTTYYR

SEQ ID NO: 613 - protein, 13 aa, Artificial Sequence
  Synthesized molecular recognition unit - heavy CDR2
SGISRDGGRTSYS

SEQ ID NO: 614 - protein, 13 aa, Artificial Sequence
  Synthesized molecular recognition unit - heavy CDR2
SGISWNSGNIGYA

SEQ ID NO: 615 - protein, 13 aa, Artificial Sequence
  Synthesized molecular recognition unit - heavy CDR2
SGISWNSGSIGYA

SEQ ID NO: 616 - protein, 13 aa, Artificial Sequence
  Synthesized molecular recognition unit - heavy CDR2
SGITGSGGRTFYA

SEQ ID NO: 617 - protein, 13 aa, Artificial Sequence
  Synthesized molecular recognition unit - heavy CDR2
SGVGGSGGSTZYA

SEQ ID NO: 618 - protein, 13 aa, Artificial Sequence
  Synthesized molecular recognition unit - heavy CDR2
SGVSWNGSRTHYV

SEQ ID NO: 619 - protein, 13 aa, Artificial Sequence
  Synthesized molecular recognition unit - heavy CDR2
SHISSGGATIDYA

SEQ ID NO: 620 - protein, 13 aa, Artificial Sequence
  Synthesized molecular recognition unit - heavy CDR2
SLISGSGDNTNYA

SEQ ID NO: 621 - protein, 13 aa, Artificial Sequence
  Synthesized molecular recognition unit - heavy CDR2
SLVSFDGSKEHYA

SEQ ID NO: 622 - protein, 13 aa, Artificial Sequence
  Synthesized molecular recognition unit - heavy CDR2
SRIDTDGSTTVYA

SEQ ID NO: 623 - protein, 13 aa, Artificial Sequence
  Synthesized molecular recognition unit - heavy CDR2
SRINGDGSNTNYA

SEQ ID NO: 624 - protein, 13 aa, Artificial Sequence
  Synthesized molecular recognition unit - heavy CDR2
SRINGDGSSTRYA

SEQ ID NO: 625 - protein, 13 aa, Artificial Sequence
  Synthesized molecular recognition unit - heavy CDR2
SRINSDGSTISYA

SEQ ID NO: 626 - protein, 13 aa, Artificial Sequence
  Synthesized molecular recognition unit - heavy CDR2
SRINYDGSATTYA

SEQ ID NO: 627 - protein, 13 aa, Artificial Sequence
  Synthesized molecular recognition unit - heavy CDR2
SRISNSGSLVYYA

SEQ ID NO: 628 - protein, 13 aa, Artificial Sequence
  Synthesized molecular recognition unit - heavy CDR2
SRISPDGRTTTYA

SEQ ID NO: 629 - protein, 13 aa, Artificial Sequence
  Synthesized molecular recognition unit - heavy CDR2
SSIDGNGDHVFYA

SEQ ID NO: 630 - protein, 13 aa, Artificial Sequence
  Synthesized molecular recognition unit - heavy CDR2
SSINNSSRTVFYA

SEQ ID NO: 631 - protein, 13 aa, Artificial Sequence
  Synthesized molecular recognition unit - heavy CDR2
SSISAAGAYKYYA

SEQ ID NO: 632 - protein, 13 aa, Artificial Sequence
  Synthesized molecular recognition unit - heavy CDR2
SSISGGGRHTYYA

SEQ ID NO: 633 - protein, 13 aa, Artificial Sequence
  Synthesized molecular recognition unit - heavy CDR2
SSISGLGGSTYZA

SEQ ID NO: 634 - protein, 13 aa, Artificial Sequence
  Synthesized molecular recognition unit - heavy CDR2
SSISSGNSYIYYA

SEQ ID NO: 635 - protein, 13 aa, Artificial Sequence
  Synthesized molecular recognition unit - heavy CDR2
SSISSSSHYKYYA

SEQ ID NO: 636 - protein, 13 aa, Artificial Sequence
  Synthesized molecular recognition unit - heavy CDR2
SSISSSSSYIYYA

SEQ ID NO: 637 - protein, 13 aa, Artificial Sequence
  Synthesized molecular recognition unit - heavy CDR2
SSISTSGGSTYYA

SEQ ID NO: 638 - protein, 13 aa, Artificial Sequence
  Synthesized molecular recognition unit - heavy CDR2
SSISWNSGRVDYA

SEQ ID NO: 639 - protein, 15 aa, Artificial Sequence
  Synthesized molecular recognition unit - heavy CDR2
SSITRTPSGGTTEYA

SEQ ID NO: 640 - protein, 11 aa, Artificial Sequence
  Synthesized molecular recognition unit - heavy CDR2
SSITTTSTLYA

SEQ ID NO: 641 - protein, 13 aa, Artificial Sequence
  Synthesized molecular recognition unit - heavy CDR2
SSLSWNSGTIVYA

SEQ ID NO: 642 - protein, 13 aa, Artificial Sequence
  Synthesized molecular recognition unit - heavy CDR2
SSTSGSGGNSKYS

SEQ ID NO: 643 - protein, 13 aa, Artificial Sequence
  Synthesized molecular recognition unit - heavy CDR2
STIAGSGGRTYYS

SEQ ID NO: 644 - protein, 12 aa, Artificial Sequence
  Synthesized molecular recognition unit - heavy CDR2
STIGPAGDTYYP

SEQ ID NO: 645 - protein, 12 aa, Artificial Sequence
  Synthesized molecular recognition unit - heavy CDR2
STIGTGGGTYYA

SEQ ID NO: 646 - protein, 13 aa, Artificial Sequence
  Synthesized molecular recognition unit - heavy CDR2
STISGGGGSTYYA

SEQ ID NO: 647 - protein, 13 aa, Artificial Sequence
  Synthesized molecular recognition unit - heavy CDR2
STISGSGGSTYYS

SEQ ID NO: 648 - protein, 13 aa, Artificial Sequence
  Synthesized molecular recognition unit - heavy CDR2
STISGSGVSTFYA

SEQ ID NO: 649 - protein, 13 aa, Artificial Sequence
  Synthesized molecular recognition unit - heavy CDR2
STISPSGLYIYQA

SEQ ID NO: 650 - protein, 13 aa, Artificial Sequence
  Synthesized molecular recognition unit - heavy CDR2
STISSSGGRTFYA

SEQ ID NO: 651 - protein, 12 aa, Artificial Sequence
  Synthesized molecular recognition unit - heavy CDR2
SVISSGGSPYYA

SEQ ID NO: 652 - protein, 13 aa, Artificial Sequence
  Synthesized molecular recognition unit - heavy CDR2
SVISTSGDTVLYT

SEQ ID NO: 653 - protein, 12 aa, Artificial Sequence
  Synthesized molecular recognition unit - heavy CDR2
SVIYGGGNTNYA

SEQ ID NO: 654 - protein, 13 aa, Artificial Sequence
  Synthesized molecular recognition unit - heavy CDR2
SYIENDGSITTYA

SEQ ID NO: 655 - protein, 13 aa, Artificial Sequence
  Synthesized molecular recognition unit - heavy CDR2
SYIGTSDGTTYYA

SEQ ID NO: 656 - protein, 13 aa, Artificial Sequence
  Synthesized molecular recognition unit - heavy CDR2
SYISAGDGFTYYA

SEQ ID NO: 657 - protein, 13 aa, Artificial Sequence
  Synthesized molecular recognition unit - heavy CDR2
SYISGAGGSTEYA

SEQ ID NO: 658 - protein, 13 aa, Artificial Sequence
  Synthesized molecular recognition unit - heavy CDR2
SYISGDSGYTNYA

SEQ ID NO: 659 - protein, 13 aa, Artificial Sequence
  Synthesized molecular recognition unit - heavy CDR2
SYISSGSYTIYYS

SEQ ID NO: 660 - protein, 13 aa, Artificial Sequence
  Synthesized molecular recognition unit - heavy CDR2
SYISSSGSITHYA

SEQ ID NO: 661 - protein, 13 aa, Artificial Sequence
  Synthesized molecular recognition unit - heavy CDR2
SYISSSSSAIYYA

SEQ ID NO: 662 - protein, 13 aa, Artificial Sequence
  Synthesized molecular recognition unit - heavy CDR2
SYISSSSSTIYYA

SEQ ID NO: 663 - protein, 13 aa, Artificial Sequence
  Synthesized molecular recognition unit - heavy CDR2
SYISTSDGSTYYA

SEQ ID NO: 664 - protein, 13 aa, Artificial Sequence
  Synthesized molecular recognition unit - heavy CDR2
SYSSGNSGYTNYA

SEQ ID NO: 665 - protein, 13 aa, Artificial Sequence
  Synthesized molecular recognition unit - heavy CDR2
TVISGSGGSTYYA

SEQ ID NO: 666 - protein, 13 aa, Artificial Sequence
  Synthesized molecular recognition unit - heavy CDR2
TVISGSGGSTYYS

SEQ ID NO: 667 - protein, 17 aa, Artificial Sequence
  Synthesized molecular recognition unit - heavy CDR2
VISGDGSYTYYADSVKG

SEQ ID NO: 668-677 - skipped (10 entries)

SEQ ID NO: 678 - protein, 15 aa, Artificial Sequence
  Synthesized molecular recognition unit - heavy CDR3
CAAASSLTSTPYDLW

SEQ ID NO: 679 - protein, 23 aa, Artificial Sequence
  Synthesized molecular recognition unit - heavy CDR3
CAADRSPYYYDSSGYYPDAFDIW

SEQ ID NO: 680 - protein, 18 aa, Artificial Sequence
  Synthesized molecular recognition unit - heavy CDR3
CAAGFPTVFVVDGEYDYW

SEQ ID NO: 681 - protein, 17 aa, Artificial Sequence
  Synthesized molecular recognition unit - heavy CDR3
CAAGPIARWYRGDMDYW

SEQ ID NO: 682 - protein, 19 aa, Artificial Sequence
  Synthesized molecular recognition unit - heavy CDR3
CAAGPNYSWFMPSSSRLIW

SEQ ID NO: 683 - protein, 12 aa, Artificial Sequence
  Synthesized molecular recognition unit - heavy CDR3
CAAGPTLPFRYW

SEQ ID NO: 684 - protein, 12 aa, Artificial Sequence
  Synthesized molecular recognition unit - heavy CDR3
CAAGVTGSWRYW

SEQ ID NO: 685 - protein, 15 aa, Artificial Sequence
  Synthesized molecular recognition unit - heavy CDR3
CAAPDVVVTADGYYW

SEQ ID NO: 686 - protein, 7 aa, Artificial Sequence
  Synthesized molecular recognition unit - heavy CDR3
CAAPDYW

SEQ ID NO: 687 - protein, 22 aa, Artificial Sequence
  Synthesized molecular recognition unit - heavy CDR3
CAAPQSPNMYIRTDQLWWYKYW

SEQ ID NO: 688 - protein, 22 aa, Artificial Sequence
  Synthesized molecular recognition unit - heavy CDR3
CAAQKPYYNGHFYADDKHYDHW

SEQ ID NO: 689 - protein, 19 aa, Artificial Sequence
  Synthesized molecular recognition unit - heavy CDR3
CAAVFLSRNYEIQEYYRYQ

SEQ ID NO: 690 - protein, 10 aa, Artificial Sequence
  Synthesized molecular recognition unit - heavy CDR3
CADGSGTSHR

SEQ ID NO: 691 - protein, 11 aa, Artificial Sequence
  Synthesized molecular recognition unit - heavy CDR3
CAESLTSTADW

SEQ ID NO: 692 - protein, 9 aa, Artificial Sequence
  Synthesized molecular recognition unit - heavy CDR3
CAGGEVYEL

SEQ ID NO: 693 - protein, 15 aa, Artificial Sequence
  Synthesized molecular recognition unit - heavy CDR3
CAHSDFFSGLSFGDW

SEQ ID NO: 694 - protein, 9 aa, Artificial Sequence
  Synthesized molecular recognition unit - heavy CDR3
CAIRAFDIW

SEQ ID NO: 695 - protein, 15 aa, Artificial Sequence
  Synthesized molecular recognition unit - heavy CDR3
CAKAGDWGLYGMDVW

SEQ ID NO: 696 - protein, 10 aa, Artificial Sequence
  Synthesized molecular recognition unit - heavy CDR3
CAKAGQQLDW

SEQ ID NO: 697 - protein, 16 aa, Artificial Sequence
  Synthesized molecular recognition unit - heavy CDR3
CAKASTPMVQGAPDYW

SEQ ID NO: 698 - protein, 8 aa, Artificial Sequence
  Synthesized molecular recognition unit - heavy CDR3
CAKDGVVR

SEQ ID NO: 699 - protein, 7 aa, Artificial Sequence [sequence omitted]

SEQ ID NO: 700 - protein, 14 aa, Artificial Sequence
  Synthesized molecular recognition unit - heavy CDR3
CAKDHLAVADAHGR

SEQ ID NO: 701 - protein, 16 aa, Artificial Sequence
  Synthesized molecular recognition unit - heavy CDR3
CAKDIGSSWYYYMDVW

SEQ ID NO: 702 - protein, 17 aa, Artificial Sequence
  Synthesized molecular recognition unit - heavy CDR3
CAKDITPYGDYSILSHW

SEQ ID NO: 703 - protein, 17 aa, Artificial Sequence
  Synthesized molecular recognition unit - heavy CDR3
CAKDKVPYSYGPNFDYW

SEQ ID NO: 704 - protein, 16 aa, Artificial Sequence
  Synthesized molecular recognition unit - heavy CDR3
CAKDLVPWGSSAFNIW

SEQ ID NO: 705 - protein, 19 aa, Artificial Sequence
  Synthesized molecular recognition unit - heavy CDR3
CAKDLVPYCSGGSCPPSGW

SEQ ID NO: 706 - protein, 12 aa, Artificial Sequence
  Synthesized molecular recognition unit - heavy CDR3
CAKDNGWYFDLW

SEQ ID NO: 707 - protein, 15 aa, Artificial Sequence
  Synthesized molecular recognition unit - heavy CDR3
CAKDRGNYGDYLDYW

SEQ ID NO: 708 - protein, 16 aa, Artificial Sequence
  Synthesized molecular recognition unit - heavy CDR3
CAKDRGYSSGWYLDYW

SEQ ID NO: 709 - protein, 25 aa, Artificial Sequence
  Synthesized molecular recognition unit - heavy CDR3
CAKDSIGRRGRGAPQPYYYYGMDVW

SEQ ID NO: 710 - protein, 8 aa, Artificial Sequence
  Synthesized molecular recognition unit - heavy CDR3
CAKDVNYW

SEQ ID NO: 711 - protein, 16 aa, Artificial Sequence
  Synthesized molecular recognition unit - heavy CDR3
CAKGAGYGSGSWQAAW

SEQ ID NO: 712 - protein, 12 aa, Artificial Sequence
  Synthesized molecular recognition unit - heavy CDR3
CAKGDYGALDYW

SEQ ID NO: 713 - protein, 14 aa, Artificial Sequence
  Synthesized molecular recognition unit - heavy CDR3
CAKGGQWLYGMDVW

SEQ ID NO: 714 - protein, 16 aa, Artificial Sequence
  Synthesized molecular recognition unit - heavy CDR3
CAKGGRDGYKGYFDYW

SEQ ID NO: 715 - protein, 13 aa, Artificial Sequence
  Synthesized molecular recognition unit - heavy CDR3
CAKGGWRSSFDPW

SEQ ID NO: 716 - protein, 11 aa, Artificial Sequence
  Synthesized molecular recognition unit - heavy CDR3
CAKGIRWFDPW

SEQ ID NO: 717 - protein, 15 aa, Artificial Sequence
  Synthesized molecular recognition unit - heavy CDR3
CAKGIVGDYGAFDIW

SEQ ID NO: 718 - protein, 12 aa, Artificial Sequence
  Synthesized molecular recognition unit - heavy CDR3
CAKGLWGPLLNW

SEQ ID NO: 719 - protein, 11 aa, Artificial Sequence
  Synthesized molecular recognition unit - heavy CDR3
CAKGNWAFDIW

SEQ ID NO: 720 - protein, 16 aa, Artificial Sequence
  Synthesized molecular recognition unit - heavy CDR3
CAKGSLLLGYYGMDVW

SEQ ID NO: 721 - protein, 18 aa, Artificial Sequence
  Synthesized molecular recognition unit - heavy CDR3
CAKGSVFGLKAGGYADYW

SEQ ID NO: 722 - protein, 21 aa, Artificial Sequence
  Synthesized molecular recognition unit - heavy CDR3
CAKGSYYYDNSGYYWDAFDIW

SEQ ID NO: 723 - protein, 21 aa, Artificial Sequence
  Synthesized molecular recognition unit - heavy CDR3
CAKGSYYYDSSGYYWDAFDIW

SEQ ID NO: 724 - protein, 16 aa, Artificial Sequence
  Synthesized molecular recognition unit - heavy CDR3
CAKLGGSSWLREYDYW

SEQ ID NO: 725 - protein, 18 aa, Artificial Sequence
  Synthesized molecular recognition unit - heavy CDR3
CAKPGIAAAGTNNWFDPW

SEQ ID NO: 726 - protein, 13 aa, Artificial Sequence
  Synthesized molecular recognition unit - heavy CDR3
CAKTGRGYAFDIW

SEQ ID NO: 727 - protein, 9 aa, Artificial Sequence
  Synthesized molecular recognition unit - heavy CDR3
CAKTKLPIW

SEQ ID NO: 728 - protein, 14 aa, Artificial Sequence
  Synthesized molecular recognition unit - heavy CDR3
CAKTLVTSHALHIW

SEQ ID NO: 729 - protein, 16 aa, Artificial Sequence
  Synthesized molecular recognition unit - heavy CDR3
CAKWHIGATGNWFDPW

SEQ ID NO: 730 - protein, 22 aa, Artificial Sequence
  Synthesized molecular recognition unit - heavy CDR3
CALLVGAARGISYYYYYGMDVW

SEQ ID NO: 731 - protein, 14 aa, Artificial Sequence
  Synthesized molecular recognition unit - heavy CDR3
CALSSSWYGGFDYW

SEQ ID NO: 732 - protein, 11 aa, Artificial Sequence
  Synthesized molecular recognition unit - heavy CDR3
CANGSYAQHLW

SEQ ID NO: 733 - protein, 12 aa, Artificial Sequence
  Synthesized molecular recognition unit - heavy CDR3
CAPNESGNVDYW

SEQ ID NO: 734 - protein, 17 aa, Artificial Sequence
  Synthesized molecular recognition unit - heavy CDR3
CAPRVLVTAPSGGMDYW

SEQ ID NO: 735 - protein, 7 aa, Artificial Sequence
  Synthesized molecular recognition unit - heavy CDR3
CAQGTYW

SEQ ID NO: 736 - protein, 14 aa, Artificial Sequence
  Synthesized molecular recognition unit - heavy CDR3
CARAAAGSYGGGYW

SEQ ID NO: 737 - protein, 20 aa, Artificial Sequence
  Synthesized molecular recognition unit - heavy CDR3
CARAALGYCTGGVCPPVDYW

SEQ ID NO: 738 - protein, 20 aa, Artificial Sequence
  Synthesized molecular recognition unit - heavy CDR3
CARADDYYDSSGYYYGFDYW

SEQ ID NO: 739 - protein, 11 aa, Artificial Sequence
  Synthesized molecular recognition unit - heavy CDR3
CARAGDSPDYW

SEQ ID NO: 740 - protein, 14 aa, Artificial Sequence
  Synthesized molecular recognition unit - heavy CDR3
CARAGSGYYNFDYW

SEQ ID NO: 741 - protein, 14 aa, Artificial Sequence
  Synthesized molecular recognition unit - heavy CDR3
CARAGVATIAFDYW

SEQ ID NO: 742 - protein, 12 aa, Artificial Sequence
  Synthesized molecular recognition unit - heavy CDR3
CARAIPGDYDYW

SEQ ID NO: 743 - protein, 20 aa, Artificial Sequence
  Synthesized molecular recognition unit - heavy CDR3
CARAIVGATGLNRFKAFDIW

SEQ ID NO: 744 - protein, 18 aa, Artificial Sequence
  Synthesized molecular recognition unit - heavy CDR3
CARAKGSGWYVGSAFDIW

SEQ ID NO: 745 - protein, 17 aa, Artificial Sequence
  Synthesized molecular recognition unit - heavy CDR3
CARAMWSYGQQNAFDIW

SEQ ID NO: 746 - protein, 16 aa, Artificial Sequence
  Synthesized molecular recognition unit - heavy CDR3
CARAPLDGSGSYYVDW

SEQ ID NO: 747 - protein, 15 aa, Artificial Sequence
  Synthesized molecular recognition unit - heavy CDR3
CARAPSYSSGWYVRW

SEQ ID NO: 748 - protein, 19 aa, Artificial Sequence
  Synthesized molecular recognition unit - heavy CDR3
CARAPYYYGSGSLFRLDYW

SEQ ID NO: 749 - protein, 13 aa, Artificial Sequence
  Synthesized molecular recognition unit - heavy CDR3
CARARGGDSPLSL

SEQ ID NO: 750 - protein, 19 aa, Artificial Sequence
  Synthesized molecular recognition unit - heavy CDR3
CARARLLGGYYTPDRMDVW

SEQ ID NO: 751 - protein, 16 aa, Artificial Sequence
  Synthesized molecular recognition unit - heavy CDR3
CARARSSGWTDAFDIW

SEQ ID NO: 752 - protein, 16 aa, Artificial Sequence
  Synthesized molecular recognition unit - heavy CDR3
CARASAWTPYGAFDIW

SEQ ID NO: 753 - protein, 23 aa, Artificial Sequence
  Synthesized molecular recognition unit - heavy CDR3
CARASLYYDYVWGSYRHYYFDYW

SEQ ID NO: 754 - protein, 17 aa, Artificial Sequence
  Synthesized molecular recognition unit - heavy CDR3
CARASRIDGGWPIIDHL

SEQ ID NO: 755 - protein, 18 aa, Artificial Sequence
  Synthesized molecular recognition unit - heavy CDR3
CARASSWYLHYYYGMDVW

SEQ ID NO: 756 - protein, 13 aa, Artificial Sequence
  Synthesized molecular recognition unit - heavy CDR3
CARASTSGDYSLW

SEQ ID NO: 757 - protein, 15 aa, Artificial Sequence
  Synthesized molecular recognition unit - heavy CDR3
CARATGFGTVVFDYW

SEQ ID NO: 758 - protein, 17 aa, Artificial Sequence
  Synthesized molecular recognition unit - heavy CDR3
CARATQELLLPYGMDVW

SEQ ID NO: 759 - protein, 26 aa, Artificial Sequence
  Synthesized molecular recognition unit - heavy CDR3
CARATSLGRRYCSSTSCYPRDAFDIW

SEQ ID NO: 760 - protein, 14 aa, Artificial Sequence
  Synthesized molecular recognition unit - heavy CDR3
CARATYGGDAFDIW

SEQ ID NO: 761 - protein, 18 aa, Artificial Sequence
  Synthesized molecular recognition unit - heavy CDR3
CARAWKGLWFGEGTFDYW

SEQ ID NO: 762 - protein, 19 aa, Artificial Sequence
  Synthesized molecular recognition unit - heavy CDR3
CARDADSSGYYRYDAFDIW

SEQ ID NO: 763 - protein, 12 aa, Artificial Sequence
  Synthesized molecular recognition unit - heavy CDR3
CARDAYNWFDPR

SEQ ID NO: 764 - protein, 12 aa, Artificial Sequence
  Synthesized molecular recognition unit - heavy CDR3
CARDAYNWFDPW

SEQ ID NO: 765 - protein, 17 aa, Artificial Sequence
  Synthesized molecular recognition unit - heavy CDR3
CARDCSGGSCYSHFDYW

SEQ ID NO: 766 - protein, 17 aa, Artificial Sequence
  Synthesized molecular recognition unit - heavy CDR3
CARDEGAGYYYYYMDVW

SEQ ID NO: 767 - protein, 13 aa, Artificial Sequence
  Synthesized molecular recognition unit - heavy CDR3
CARDGGDYGMDVW

SEQ ID NO: 768 - protein, 8 aa, Artificial Sequence [sequence omitted]

SEQ ID NO: 769 - protein, 13 aa, Artificial Sequence
  Synthesized molecular recognition unit - heavy CDR3
CARDGIWDIFDYW

SEQ ID NO: 770 - protein, 18 aa, Artificial Sequence
  Synthesized molecular recognition unit - heavy CDR3
CARDGSSGWYSPNAFDIW

SEQ ID NO: 771 - protein, 7 aa, Artificial Sequence
  Synthesized molecular recognition unit - heavy CDR3
CARDGSW

SEQ ID NO: 772 - protein, 17 aa, Artificial Sequence
  Synthesized molecular recognition unit - heavy CDR3
CARDGTPFYSGSYYGSW

SEQ ID NO: 773 - protein, 7 aa, Artificial Sequence
  Synthesized molecular recognition unit - heavy CDR3
CARDGVE

SEQ ID NO: 774 - protein, 19 aa, Artificial Sequence
  Synthesized molecular recognition unit - heavy CDR3
CARDHGSSWYQNTDAFDIW

SEQ ID NO: 775 - protein, 14 aa, Artificial Sequence
  Synthesized molecular recognition unit - heavy CDR3
CARDITGADGMDVW

SEQ ID NO: 776 - protein, 12 aa, Artificial Sequence
  Synthesized molecular recognition unit - heavy CDR3
CARDLDSGFDLW

SEQ ID NO: 777 - protein, 15 aa, Artificial Sequence
  Synthesized molecular recognition unit - heavy CDR3
CARDLMVGRNKLDYW

SEQ ID NO: 778 - protein, 20 aa, Artificial Sequence
  Synthesized molecular recognition unit - heavy CDR3
CARDLRFYSSSWRRVGMDVW

SEQ ID NO: 779 - protein, 19 aa, Artificial Sequence
  Synthesized molecular recognition unit - heavy CDR3
CARDLSPMVRGVISGMDVW

SEQ ID NO: 780 - protein, 18 aa, Artificial Sequence
  Synthesized molecular recognition unit - heavy CDR3
CARDLTPFTQQQLVLGLL

SEQ ID NO: 781 - protein, 23 aa, Artificial Sequence
  Synthesized molecular recognition unit - heavy CDR3
CARDLTYYYDSSGHSPLGAFDIW

SEQ ID NO: 782 - protein, 16 aa, Artificial Sequence
  Synthesized molecular recognition unit - heavy CDR3
CARDLVAARPSNWDYW

SEQ ID NO: 783 - protein, 23 aa, Artificial Sequence
  Synthesized molecular recognition unit - heavy CDR3
CARDNGYCSGGSCYATYYGMDVR

SEQ ID NO: 784 - protein, 18 aa, Artificial Sequence
  Synthesized molecular recognition unit - heavy CDR3
CARDPIMFGDQPGWFDPW

SEQ ID NO: 785 - protein, 15 aa, Artificial Sequence
  Synthesized molecular recognition unit - heavy CDR3
CARDQNDSWYRSDYW

SEQ ID NO: 786 - protein, 22 aa, Artificial Sequence
  Synthesized molecular recognition unit - heavy CDR3
CARDRDIVVVPAQRGEGGFDPW

SEQ ID NO: 787 - protein, 8 aa, Artificial Sequence [sequence omitted]

SEQ ID NO: 788 - protein, 13 aa, Artificial Sequence
  Synthesized molecular recognition unit - heavy CDR3
CARDRFDNWFDPW

SEQ ID NO: 789 - protein, 11 aa, Artificial Sequence
  Synthesized molecular recognition unit - heavy CDR3
CARDRLAFDYW

SEQ ID NO: 790 - protein, 11 aa, Artificial Sequence
  Synthesized molecular recognition unit - heavy CDR3
CARDRPGFDPW

SEQ ID NO: 791 - protein, 16 aa, Artificial Sequence
  Synthesized molecular recognition unit - heavy CDR3
CARDRPSSSWYAFDYW

SEQ ID NO: 792 - protein, 16 aa, Artificial Sequence
  Synthesized molecular recognition unit - heavy CDR3
CARDRPTSSWYAFDYW

SEQ ID NO: 793 - protein, 19 aa, Artificial Sequence
  Synthesized molecular recognition unit - heavy CDR3
CARDRPYSSGWYYPAFDIW

SEQ ID NO: 794 - protein, 17 aa, Artificial Sequence
  Synthesized molecular recognition unit - heavy CDR3
CARDRQLGWAHWYFDLW

SEQ ID NO: 795 - protein, 13 aa, Artificial Sequence
  Synthesized molecular recognition unit - heavy CDR3
CARDRRGYGMDVW

SEQ ID NO: 796 - protein, 22 aa, Artificial Sequence
  Synthesized molecular recognition unit - heavy CDR3
CARDRVTLRGGYSYGTDAFDIW

SEQ ID NO: 797 - protein, 16 aa, Artificial Sequence
  Synthesized molecular recognition unit - heavy CDR3
CARDSDFWYYYGMDVW

SEQ ID NO: 798 - protein, 19 aa, Artificial Sequence
  Synthesized molecular recognition unit - heavy CDR3
CARDSSSGWYASYYGMDVW

SEQ ID NO: 799 - protein, 19 aa, Artificial Sequence
  Synthesized molecular recognition unit - heavy CDR3
CARDSSSWYSYYYYYMDVW

SEQ ID NO: 800 - protein, 13 aa, Artificial Sequence
  Synthesized molecular recognition unit - heavy CDR3
CARDSYPYGMDVW

SEQ ID NO: 801 - protein, 16 aa, Artificial Sequence
  Synthesized molecular recognition unit - heavy CDR3
CARDTCSSTSCSPDYW

SEQ ID NO: 802 - protein, 16 aa, Artificial Sequence
  Synthesized molecular recognition unit - heavy CDR3
CARDVCSGGSCSPDVW

SEQ ID NO: 803 - protein, 9 aa, Artificial Sequence
  Synthesized molecular recognition unit - heavy CDR3
CARDVMDVW

SEQ ID NO: 804 - protein, 20 aa, Artificial Sequence
  Synthesized molecular recognition unit - heavy CDR3
CARDVPKLVTRGVAYGMDVW

SEQ ID NO: 805 - protein, 15 aa, Artificial Sequence
  Synthesized molecular recognition unit - heavy CDR3
CAREAGTTGGWFDPW

SEQ ID NO: 806 - protein, 22 aa, Artificial Sequence
  Synthesized molecular recognition unit - heavy CDR3
CAREANYDILTGYIRPDAFDIW

SEQ ID NO: 807 - protein, 14 aa, Artificial Sequence
  Synthesized molecular recognition unit - heavy CDR3
CAREEWELFGMDVW

SEQ ID NO: 808 - protein, 18 aa, Artificial Sequence
  Synthesized molecular recognition unit - heavy CDR3
CAREGRSRVYGGNSFDYW

SEQ ID NO: 809 - protein, 15 aa, Artificial Sequence
  Synthesized molecular recognition unit - heavy CDR3
CAREGSYYDWYFDLW

SEQ ID NO: 810 - protein, 17 aa, Artificial Sequence
  Synthesized molecular recognition unit - heavy CDR3
CAREGWFGESPFGMDVW

SEQ ID NO: 811 - protein, 18 aa, Artificial Sequence
  Synthesized molecular recognition unit - heavy CDR3
CAREGYDFWSGPYAFDIW

SEQ ID NO: 812 - protein, 17 aa, Artificial Sequence
  Synthesized molecular recognition unit - heavy CDR3
CARELLPMTTVTSPFIW

SEQ ID NO: 813 - protein, 15 aa, Artificial Sequence
  Synthesized molecular recognition unit - heavy CDR3
CARESVNNYYYMDVW

SEQ ID NO: 814 - protein, 15 aa, Artificial Sequence
  Synthesized molecular recognition unit - heavy CDR3
CARETTDYYYGMDVW

SEQ ID NO: 815 - protein, 12 aa, Artificial Sequence
  Synthesized molecular recognition unit - heavy CDR3
CAREYLGSFDIW

SEQ ID NO: 816 - protein, 13 aa, Artificial Sequence
  Synthesized molecular recognition unit - heavy CDR3
CARFDYFGGMDVW

SEQ ID NO: 817 - protein, 18 aa, Artificial Sequence
  Synthesized molecular recognition unit - heavy CDR3
CARFYYDILNGYSYFDYW

SEQ ID NO: 818 - protein, 18 aa, Artificial Sequence
  Synthesized molecular recognition unit - heavy CDR3
CARFYYDILTGYSYFDYW

SEQ ID NO: 819 - protein, 11 aa, Artificial Sequence
  Synthesized molecular recognition unit - heavy CDR3
CARGALGMDVW

SEQ ID NO: 820 - protein, 10 aa, Artificial Sequence [sequence omitted]

SEQ ID NO: 821 - protein, 13 aa, Artificial Sequence
  Synthesized molecular recognition unit - heavy CDR3
CARGARLYGCDYW

SEQ ID NO: 822 - protein, 13 aa, Artificial Sequence
  Synthesized molecular recognition unit - heavy CDR3
CARGARLYGFDYW

SEQ ID NO: 823 - protein, 13 aa, Artificial Sequence
  Synthesized molecular recognition unit - heavy CDR3
CARGDSGSYRDYW

SEQ ID NO: 824 - protein, 23 aa, Artificial Sequence
  Synthesized molecular recognition unit - heavy CDR3
CARGDYDFWSGYHEYYYYGMDVW

SEQ ID NO: 825 - protein, 19 aa, Artificial Sequence
  Synthesized molecular recognition unit - heavy CDR3
CARGFCSGGSCLWYGMDVW

SEQ ID NO: 826 - protein, 16 aa, Artificial Sequence
  Synthesized molecular recognition unit - heavy CDR3
CARGGAGRFGEGMDVW

SEQ ID NO: 827 - protein, 22 aa, Artificial Sequence
  Synthesized molecular recognition unit - heavy CDR3
CARGGEYSSGWTYYYYYGMDVW

SEQ ID NO: 828 - protein, 11 aa, Artificial Sequence [sequence omitted]

SEQ ID NO: 829 - protein, 11 aa, Artificial Sequence
  Synthesized molecular recognition unit - heavy CDR3
CARGGGYSSSW

SEQ ID NO: 830 - protein, 13 aa, Artificial Sequence
  Synthesized molecular recognition unit - heavy CDR3
CARGGLDGPIDYR

SEQ ID NO: 831 - protein, 11 aa, Artificial Sequence
  Synthesized molecular recognition unit - heavy CDR3
CARGGLLFDYW

SEQ ID NO: 832 - protein, 20 aa, Artificial Sequence
  Synthesized molecular recognition unit - heavy CDR3
CARGGLLRFGDGWGMGMDVW

SEQ ID NO: 833 - protein, 13 aa, Artificial Sequence
  Synthesized molecular recognition unit - heavy CDR3
CARGGNYGSGDYW

SEQ ID NO: 834 - protein, 18 aa, Artificial Sequence
  Synthesized molecular recognition unit - heavy CDR3
CARGGPIHYYYYYYMDVW

SEQ ID NO: 835 - protein, 20 aa, Artificial Sequence
  Synthesized molecular recognition unit - heavy CDR3
CARGGQGGYDWGHYHGLDVW

SEQ ID NO: 836 - protein, 13 aa, Artificial Sequence
  Synthesized molecular recognition unit - heavy CDR3
CARGGSGGNLSYW

SEQ ID NO: 837 - protein, 20 aa, Artificial Sequence
  Synthesized molecular recognition unit - heavy CDR3
CARGGSRYDFWSGHWYFDLW

SEQ ID NO: 838 - protein, 10 aa, Artificial Sequence
  Synthesized molecular recognition unit - heavy CDR3
CARGGSSDVR

SEQ ID NO: 839 - protein, 15 aa, Artificial Sequence
  Synthesized molecular recognition unit - heavy CDR3
CARGGSTGYYGMDVW

SEQ ID NO: 840 - protein, 22 aa, Artificial Sequence
  Synthesized molecular recognition unit - heavy CDR3
CARGGWRPDYYGSGSYYSFDYW

SEQ ID NO: 841 - protein, 16 aa, Artificial Sequence
  Synthesized molecular recognition unit - heavy CDR3
CARGGWTNYGGNLDYW

SEQ ID NO: 842 - protein, 15 aa, Artificial Sequence
  Synthesized molecular recognition unit - heavy CDR3
CARGGYSYGTVFDYW

SEQ ID NO: 843 - protein, 13 aa, Artificial Sequence [sequence omitted]

SEQ ID NO: 844 - protein, 16 aa, Artificial Sequence
  Synthesized molecular recognition unit - heavy CDR3
CARGKEGRYSNYEAAW

SEQ ID NO: 845 - protein, 19 aa, Artificial Sequence
  Synthesized molecular recognition unit - heavy CDR3
CARGKGYSYGYGKDWFDPW

SEQ ID NO: 846 - protein, 12 aa, Artificial Sequence
  Synthesized molecular recognition unit - heavy CDR3
CARGKSGSFDYW

SEQ ID NO: 847 - protein, 18 aa, Artificial Sequence
  Synthesized molecular recognition unit - heavy CDR3
CARGLPPAAGGGGYFQHW

SEQ ID NO: 848 - protein, 23 aa, Artificial Sequence
  Synthesized molecular recognition unit - heavy CDR3
CARGLRYFDWPQGIYYYYGMDVW

SEQ ID NO: 849 - protein, 15 aa, Artificial Sequence
  Synthesized molecular recognition unit - heavy CDR3
CARGLVIATNWFDPW

SEQ ID NO: 850 - protein, 23 aa, Artificial Sequence
  Synthesized molecular recognition unit - heavy CDR3
CARGNPTSGHIVVVPAATFSDYW

SEQ ID NO: 851 - protein, 16 aa, Artificial Sequence
  Synthesized molecular recognition unit - heavy CDR3
CARGPKTMWEDRPDYW

SEQ ID NO: 852 - protein, 18 aa, Artificial Sequence
  Synthesized molecular recognition unit - heavy CDR3
CARGPLPTKIGGHYMDVW

SEQ ID NO: 853 - protein, 19 aa, Artificial Sequence
  Synthesized molecular recognition unit - heavy CDR3
CARGPRDSGYYPGGAFDIW

SEQ ID NO: 854 - protein, 14 aa, Artificial Sequence
  Synthesized molecular recognition unit - heavy CDR3
CARGPSHQHTFDIW

SEQ ID NO: 855 - protein, 20 aa, Artificial Sequence
  Synthesized molecular recognition unit - heavy CDR3
CARGQGYSSGWYRGDAFDIW

SEQ ID NO: 856 - protein, 19 aa, Artificial Sequence
  Synthesized molecular recognition unit - heavy CDR3
CARGQSEKWWSGLYGMDVW

SEQ ID NO: 857 - protein, 19 aa, Artificial Sequence
  Synthesized molecular recognition unit - heavy CDR3
CARGRGQQWLTGYYGMDVW

SEQ ID NO: 858 - protein, 19 aa, Artificial Sequence
  Synthesized molecular recognition unit - heavy CDR3
CARGRRLVRFTVTSAFDIW

SEQ ID NO: 859 - protein, 13 aa, Artificial Sequence
  Synthesized molecular recognition unit - heavy CDR3
CARGRVWSSRDYW

SEQ ID NO: 860 - protein, 14 aa, Artificial Sequence
  Synthesized molecular recognition unit - heavy CDR3
CARGSGIAASGSYW

SEQ ID NO: 861 - protein, 17 aa, Artificial Sequence
  Synthesized molecular recognition unit - heavy CDR3
CARGSGYDFFDYGMDVW

SEQ ID NO: 862 - protein, 12 aa, Artificial Sequence
  Synthesized molecular recognition unit - heavy CDR3
CARGSSGYYVAW

SEQ ID NO: 863 - protein, 11 aa, Artificial Sequence
  Synthesized molecular recognition unit - heavy CDR3
CARGSSSWYDW

SEQ ID NO: 864 - protein, 7 aa, Artificial Sequence [sequence omitted]

SEQ ID NO: 865 - protein, 17 aa, Artificial Sequence
  Synthesized molecular recognition unit - heavy CDR3
CARGTFDWLLSPSYDYW

SEQ ID NO: 866 - protein, 19 aa, Artificial Sequence
  Synthesized molecular recognition unit - heavy CDR3
CARGTFLEWLLTNYGMDVW

SEQ ID NO: 867 - protein, 11 aa, Artificial Sequence
  Synthesized molecular recognition unit - heavy CDR3
CARGTGGFDYW

SEQ ID NO: 868 - protein, 14 aa, Artificial Sequence
  Synthesized molecular recognition unit - heavy CDR3
CARGVVGSGAFDIW

SEQ ID NO: 869 - protein, 20 aa, Artificial Sequence
  Synthesized molecular recognition unit - heavy CDR3
CARGVWTTPMGGGGNWFDPW

SEQ ID NO: 870 - protein, 24 aa, Artificial Sequence
  Synthesized molecular recognition unit - heavy CDR3
CARGVYPYSSKHKPSYYYYGMDVW

SEQ ID NO: 871 - protein, 11 aa, Artificial Sequence
  Synthesized molecular recognition unit - heavy CDR3
CARGWAGFDYW

SEQ ID NO: 872 - protein, 14 aa, Artificial Sequence
  Synthesized molecular recognition unit - heavy CDR3
CARGWTTISSLGVW

SEQ ID NO: 873 - protein, 18 aa, Artificial Sequence
  Synthesized molecular recognition unit - heavy CDR3
CARGYGDYVWGENYFDYW

SEQ ID NO: 874 - protein, 12 aa, Artificial Sequence [sequence omitted]

SEQ ID NO: 875 - protein, 17 aa, Artificial Sequence
  Synthesized molecular recognition unit - heavy CDR3
CARHAGFYGLADYFDYW

SEQ ID NO: 876 - protein, 12 aa, Artificial Sequence
  Synthesized molecular recognition unit - heavy CDR3
CARHGRIAADIW

SEQ ID NO: 877 - protein, 18 aa, Artificial Sequence
  Synthesized molecular recognition unit - heavy CDR3
CARHNPGYMGYYYGMDVW

SEQ ID NO: 878 - protein, 18 aa, Artificial Sequence
  Synthesized molecular recognition unit - heavy CDR3
CARHVYGSGTYNNWFDPW

SEQ ID NO: 879 - protein, 14 aa, Artificial Sequence
  Synthesized molecular recognition unit - heavy CDR3
CARHYYGSGNYRDW

SEQ ID NO: 880 - protein, 14 aa, Artificial Sequence [sequence omitted]

SEQ ID NO: 881 - protein, 13 aa, Artificial Sequence
  Synthesized molecular recognition unit - heavy CDR3
CARIGAGGAFDIW

SEQ ID NO: 882 - protein, 15 aa, Artificial Sequence
  Synthesized molecular recognition unit - heavy CDR3
CARIGIAVAAPVDHW

SEQ ID NO: 883 - protein, 18 aa, Artificial Sequence
  Synthesized molecular recognition unit - heavy CDR3
CARIPKPRGYSYGDNGSW

SEQ ID NO: 884 - protein, 18 aa, Artificial Sequence
  Synthesized molecular recognition unit - heavy CDR3
CARKVKGYCSGGSCYGYW

SEQ ID NO: 885 - protein, 9 aa, Artificial Sequence [sequence omitted]

SEQ ID NO: 886 - protein, 15 aa, Artificial Sequence
  Synthesized molecular recognition unit - heavy CDR3
CARLDPGYYYGMDVW

SEQ ID NO: 887 - protein, 11 aa, Artificial Sequence
  Synthesized molecular recognition unit - heavy CDR3
CARLGSTPDYW

SEQ ID NO: 888 - protein, 17 aa, Artificial Sequence
  Synthesized molecular recognition unit - heavy CDR3
CARLPRRSGKGSAFDIW

SEQ ID NO: 889 - protein, 23 aa, Artificial Sequence
  Synthesized molecular recognition unit - heavy CDR3
CARLPYYDFWSGYYGGRTGFDYW

SEQ ID NO: 890 - protein, 19 aa, Artificial Sequence
  Synthesized molecular recognition unit - heavy CDR3
CARLSVWKWEQVTNWFDPW

SEQ ID NO: 891 - protein, 21 aa, Artificial Sequence
  Synthesized molecular recognition unit - heavy CDR3
CARLSYYYDSSGPKGDAFDIW

SEQ ID NO: 892 - protein, 17 aa, Artificial Sequence
  Synthesized molecular recognition unit - heavy CDR3
CARLTGGAVAGTHRDYW

SEQ ID NO: 893 - protein, 15 aa, Artificial Sequence
  Synthesized molecular recognition unit - heavy CDR3
CARLVVRGGYGMDVW

SEQ ID NO: 894 - protein, 14 aa, Artificial Sequence
  Synthesized molecular recognition unit - heavy CDR3
CARMKDWFGAFDIW

SEQ ID NO: 895 - protein, 22 aa, Artificial Sequence
  Synthesized molecular recognition unit - heavy CDR3
CARMSSDYYDSSGYYRRGMDVW

SEQ ID NO: 896 - protein, 13 aa, Artificial Sequence
  Synthesized molecular recognition unit - heavy CDR3
CARNGIAAAEDYW

SEQ ID NO: 897 - protein, 13 aa, Artificial Sequence
  Synthesized molecular recognition unit - heavy CDR3
CARNNFLRAFDIW

SEQ ID NO: 898 - protein, 17 aa, Artificial Sequence
  Synthesized molecular recognition unit - heavy CDR3
CARNVEGATSFPEFDYW

SEQ ID NO: 899 - protein, 15 aa, Artificial Sequence
  Synthesized molecular recognition unit - heavy CDR3
CARPAGSAQNWFDPW

SEQ ID NO: 900 - protein, 14 aa, Artificial Sequence
  Synthesized molecular recognition unit - heavy CDR3
CARPIVGATAFDIW

SEQ ID NO: 901 - protein, 15 aa, Artificial Sequence
  Synthesized molecular recognition unit - heavy CDR3
CARPSTTGTKAFDIW

SEQ ID NO: 902 - protein, 14 aa, Artificial Sequence
  Synthesized molecular recognition unit - heavy CDR3
CARPSTTSFGMDVW

SEQ ID NO: 903 - protein, 14 aa, Artificial Sequence
  Synthesized molecular recognition unit - heavy CDR3
CARPYSSSRQGDYW

SEQ ID NO: 904 - protein, 19 aa, Artificial Sequence
  Synthesized molecular recognition unit - heavy CDR3
CARPYYYDSSGYDPMGDYW

SEQ ID NO: 905 - protein, 23 aa, Artificial Sequence
  Synthesized molecular recognition unit - heavy CDR3
CARQAGLHCSSTSCYLGNWFDPW

SEQ ID NO: 906 - protein, 14 aa, Artificial Sequence
  Synthesized molecular recognition unit - heavy CDR3
CARQIGWELMPDIW

SEQ ID NO: 907 - protein, 13 aa, Artificial Sequence
  Synthesized molecular recognition unit - heavy CDR3
CARQTRGGTTDGW

SEQ ID NO: 908 - protein, 19 aa, Artificial Sequence
  Synthesized molecular recognition unit - heavy CDR3
CARQYCSGGSCYPDAFDIR

SEQ ID NO: 909 - protein, 10 aa, Artificial Sequence [sequence omitted]

SEQ ID NO: 910 - protein, 18 aa, Artificial Sequence
  Synthesized molecular recognition unit - heavy CDR3
CARREPLYSSRRGAFDIW

SEQ ID NO: 911 - protein, 17 aa, Artificial Sequence
  Synthesized molecular recognition unit - heavy CDR3
CARRGYSSGWRDAFDIW

SEQ ID NO: 912 - protein, 16 aa, Artificial Sequence
  Synthesized molecular recognition unit - heavy CDR3
CARRLIAVAGAEFDPW

SEQ ID NO: 913 - protein, 20 aa, Artificial Sequence
  Synthesized molecular recognition unit - heavy CDR3
CARRSGYSGSVYYYYGMDVW

SEQ ID NO: 914 - protein, 14 aa, Artificial Sequence
  Synthesized molecular recognition unit - heavy CDR3
CARRTAVAGTIDYW

SEQ ID NO: 915 - protein, 11 aa, Artificial Sequence
  Synthesized molecular recognition unit - heavy CDR3
CARRTSASDIW

SEQ ID NO: 916 - protein, 13 aa, Artificial Sequence
  Synthesized molecular recognition unit - heavy CDR3
CARSAVAGAFDIW

SEQ ID NO: 917 - protein, 16 aa, Artificial Sequence
  Synthesized molecular recognition unit - heavy CDR3
CARSGMVKWLRSFDYW

SEQ ID NO: 918 - protein, 19 aa, Artificial Sequence
  Synthesized molecular recognition unit - heavy CDR3
CARSGPAAMVYYYYGMDVW

SEQ ID NO: 919 - protein, 15 aa, Artificial Sequence
  Synthesized molecular recognition unit - heavy CDR3
CARSGYNRRGYFDYW

SEQ ID NO: 920 - protein, 14 aa, Artificial Sequence
  Synthesized molecular recognition unit - heavy CDR3
CARSPRWYDAFDIW

SEQ ID NO: 921 - protein, 14 aa, Artificial Sequence
  Synthesized molecular recognition unit - heavy CDR3
CARSQATGERFDYW

SEQ ID NO: 922 - protein, 13 aa, Artificial Sequence
  Synthesized molecular recognition unit - heavy CDR3
CARSSDLRIFDYW

SEQ ID NO: 923 - protein, 16 aa, Artificial Sequence
  Synthesized molecular recognition unit - heavy CDR3
CARSSGWQNRFAFDIW

SEQ ID NO: 924 - protein, 14 aa, Artificial Sequence
  Synthesized molecular recognition unit - heavy CDR3
CARSSGYVGWFDPW

SEQ ID NO: 925 - protein, 10 aa, Artificial Sequence
  Synthesized molecular recognition unit - heavy CDR3
CARSTPFDPW

SEQ ID NO: 926 - protein, 24 aa, Artificial Sequence
  Synthesized molecular recognition unit - heavy CDR3
CARSVGEVGATMLGIGVWYWFDPW

SEQ ID NO: 927 - protein, 20 aa, Artificial Sequence
  Synthesized molecular recognition unit - heavy CDR3
CARSYYDSSGYPRKDAFDIW

SEQ ID NO: 928 - protein, 14 aa, Artificial Sequence
  Synthesized molecular recognition unit - heavy CDR3
CARTGRGYYGMDVW

SEQ ID NO: 929 - protein, 17 aa, Artificial Sequence
  Synthesized molecular recognition unit - heavy CDR3
CARTLTTPPYYYGMDVW

SEQ ID NO: 930 - protein, 12 aa, Artificial Sequence
  Synthesized molecular recognition unit - heavy CDR3
CARTYLKAFDIW

SEQ ID NO: 931 - protein, 22 aa, Artificial Sequence
  Synthesized molecular recognition unit - heavy CDR3
CARTYRIVGATPRYYYYGMDVW

SEQ ID NO: 932 - protein, 13 aa, Artificial Sequence
  Synthesized molecular recognition unit - heavy CDR3
CARVATGNAFDIW

SEQ ID NO: 933 - protein, 15 aa, Artificial Sequence
  Synthesized molecular recognition unit - heavy CDR3
CARVDGSGYYGIDYW

SEQ ID NO: 934 - protein, 11 aa, Artificial Sequence
  Synthesized molecular recognition unit - heavy CDR3
CARVFPLHDYW

SEQ ID NO: 935 - protein, 15 aa, Artificial Sequence
  Synthesized molecular recognition unit - heavy CDR3
CARVGATSAGGMDVW

SEQ ID NO: 936 - protein, 13 aa, Artificial Sequence
  Synthesized molecular recognition unit - heavy CDR3
CARVGPGGWFDPW

SEQ ID NO: 937 - protein, 13 aa, Artificial Sequence
  Synthesized molecular recognition unit - heavy CDR3
CARVGRGYSFDYW

SEQ ID NO: 938 - protein, 13 aa, Artificial Sequence
  Synthesized molecular recognition unit - heavy CDR3
CARVGWLRFLDYW

SEQ ID NO: 939 - protein, 16 aa, Artificial Sequence
  Synthesized molecular recognition unit - heavy CDR3
CARVIFSTVTTTNDIW

SEQ ID NO: 940 - protein, 13 aa, Artificial Sequence
  Synthesized molecular recognition unit - heavy CDR3
CARVKWELAIDYW

SEQ ID NO: 941 - protein, 25 aa, Artificial Sequence
  Synthesized molecular recognition unit - heavy CDR3
CARVLPGDSSGWYRGYYYYYGMDVW

SEQ ID NO: 942 - protein, 14 aa, Artificial Sequence
  Synthesized molecular recognition unit - heavy CDR3
CARVMLITDAFDIW

SEQ ID NO: 943 - protein, 15 aa, Artificial Sequence
  Synthesized molecular recognition unit - heavy CDR3
CARVPDFWSGYLDYW

SEQ ID NO: 944 - protein, 19 aa, Artificial Sequence
  Synthesized molecular recognition unit - heavy CDR3
CARVPTSPYDILTGPFDYW

SEQ ID NO: 945 - protein, 20 aa, Artificial Sequence
  Synthesized molecular recognition unit - heavy CDR3
CARVRARRFLVSDRSAFDIW

SEQ ID NO: 946 - protein, 21 aa, Artificial Sequence
  Synthesized molecular recognition unit - heavy CDR3
CARVRDYYDSSGYYYDYFDYW

SEQ ID NO: 947 - protein, 21 aa, Artificial Sequence
  Synthesized molecular recognition unit - heavy CDR3
CARVRSKAVAGTLPKRLFDIW

SEQ ID NO: 948 - protein, 13 aa, Artificial Sequence
  Synthesized molecular recognition unit - heavy CDR3
CARVSRGFAFDYW

SEQ ID NO: 949 - protein, 16 aa, Artificial Sequence
  Synthesized molecular recognition unit - heavy CDR3
CARVTLGASVDAFDIW

SEQ ID NO: 950 - protein, 15 aa, Artificial Sequence
  Synthesized molecular recognition unit - heavy CDR3
CARWAFPIPNAFDIW

SEQ ID NO: 951 - protein, 16 aa, Artificial Sequence
  Synthesized molecular recognition unit - heavy CDR3
CARWGDYGDLYYFDYW

SEQ ID NO: 952 - protein, 18 aa, Artificial Sequence
  Synthesized molecular recognition unit - heavy CDR3
CARWGKRLRGSPYYFDYW

SEQ ID NO: 953 - protein, 11 aa, Artificial Sequence
  Synthesized molecular recognition unit - heavy CDR3
CARWKNYFDPW

SEQ ID NO: 954 - protein, 11 aa, Artificial Sequence
  Synthesized molecular recognition unit - heavy CDR3
CARYGDYGDYW

SEQ ID NO: 955 - protein, 13 aa, Artificial Sequence
  Synthesized molecular recognition unit - heavy CDR3
CARYSSGGSLDYW

SEQ ID NO: 956 - protein, 11 aa, Artificial Sequence
  Synthesized molecular recognition unit - heavy CDR3
CASDPVTAATR

SEQ ID NO: 957 - protein, 11 aa, Artificial Sequence
  Synthesized molecular recognition unit - heavy CDR3
CASGLGYFDYW

SEQ ID NO: 958 - protein, 18 aa, Artificial Sequence
  Synthesized molecular recognition unit - heavy CDR3
CASKTTINSGWSREYHYW

SEQ ID NO: 959 - protein, 14 aa, Artificial Sequence
  Synthesized molecular recognition unit - heavy CDR3
CASPTGMTTNFDYW

SEQ ID NO: 960 - protein, 9 aa, Artificial Sequence
  Synthesized molecular recognition unit - heavy CDR3
CASPTVTRR

SEQ ID NO: 961 - protein, 18 aa, Artificial Sequence
  Synthesized molecular recognition unit - heavy CDR3
CASQNYYGSGSYPGFDYW

SEQ ID NO: 962 - protein, 13 aa, Artificial Sequence
  Synthesized molecular recognition unit - heavy CDR3
CASSHYAPGMDVW

SEQ ID NO: 963 - protein, 17 aa, Artificial Sequence
  Synthesized molecular recognition unit - heavy CDR3
CASSKEKATYYYGMDVW

SEQ ID NO: 964 - protein, 17 aa, Artificial Sequence
  Synthesized molecular recognition unit - heavy CDR3
CASSMVRVPYYYGMDVW

SEQ ID NO: 965 - protein, 16 aa, Artificial Sequence
  Synthesized molecular recognition unit - heavy CDR3
CASSRDGYNRLAFDIW

SEQ ID NO: 966 - protein, 21 aa, Artificial Sequence
  Synthesized molecular recognition unit - heavy CDR3
CASSSDYGDYLKEPNYGMDVW

SEQ ID NO: 967 - protein, 13 aa, Artificial Sequence
  Synthesized molecular recognition unit - heavy CDR3
CASTDPSSGLDYW

SEQ ID NO: 968 - protein, 11 aa, Artificial Sequence
  Synthesized molecular recognition unit - heavy CDR3
CATASGDFDYW

SEQ ID NO: 969 - protein, 14 aa, Artificial Sequence
  Synthesized molecular recognition unit - heavy CDR3
CATAYRRPGGLDVW

SEQ ID NO: 970 - protein, 26 aa, Artificial Sequence
  Synthesized molecular recognition unit - heavy CDR3
CATDLPVRKGFTYYDILTGSYGMDVW

SEQ ID NO: 971 - protein, 15 aa, Artificial Sequence
  Synthesized molecular recognition unit - heavy CDR3
CATGWPRYYYGMDVW

SEQ ID NO: 972 - protein, 14 aa, Artificial Sequence
  Synthesized molecular recognition unit - heavy CDR3
CATGYYYDYYFDYW

SEQ ID NO: 973 - protein, 15 aa, Artificial Sequence
  Synthesized molecular recognition unit - heavy CDR3
CATHDSSGYYSFDYW

SEQ ID NO: 974 - protein, 13 aa, Artificial Sequence
  Synthesized molecular recognition unit - heavy CDR3
CATLTPYGTVASY

SEQ ID NO: 975 - protein, 19 aa, Artificial Sequence
  Synthesized molecular recognition unit - heavy CDR3
CATSFGGGWIVVDTSLWYW

SEQ ID NO: 976 - protein, 22 aa, Artificial Sequence
  Synthesized molecular recognition unit - heavy CDR3
CATTQGVYSSSWYGGGRAFDIW

SEQ ID NO: 977 - protein, 25 aa, Artificial Sequence
  Synthesized molecular recognition unit - heavy CDR3
CATVQTNYYDSSGRFSYRAHYFDYW

SEQ ID NO: 978 - protein, 13 aa, Artificial Sequence
  Synthesized molecular recognition unit - heavy CDR3
CATYGDFGYFDLW

SEQ ID NO: 979 - protein, 11 aa, Artificial Sequence
  Synthesized molecular recognition unit - heavy CDR3
CEVHNFGATYW

SEQ ID NO: 980 - protein, 13 aa, Artificial Sequence
  Synthesized molecular recognition unit - heavy CDR3
CHFGVASVGLNYW

SEQ ID NO: 981 - protein, 12 aa, Artificial Sequence
  Synthesized molecular recognition unit - heavy CDR3
CIGVTYNGYTIG

SEQ ID NO: 982 - protein, 11 aa, Artificial Sequence
  Synthesized molecular recognition unit - heavy CDR3
CKVHNFEATYW

SEQ ID NO: 983 - protein, 11 aa, Artificial Sequence
  Synthesized molecular recognition unit - heavy CDR3
CKVHNFGATYW

SEQ ID NO: 984 - protein, 12 aa, Artificial Sequence
  Synthesized molecular recognition unit - heavy CDR3
CNADSLRGIDYW

SEQ ID NO: 985 - protein, 13 aa, Artificial Sequence
  Synthesized molecular recognition unit - heavy CDR3
CNADYGTWYGIGW

SEQ ID NO: 986 - protein, 22 aa, Artificial Sequence
  Synthesized molecular recognition unit - heavy CDR3
CNAGAPAWTYRMGTYYPQFGSW

SEQ ID NO: 987 - protein, 12 aa, Artificial Sequence
  Synthesized molecular recognition unit - heavy CDR3
CNALAPGVRGSW

SEQ ID NO: 988 - protein, 17 aa, Artificial Sequence
  Synthesized molecular recognition unit - heavy CDR3
CNARLDAVYGHSRYDSW

SEQ ID NO: 989 - protein, 14 aa, Artificial Sequence
  Synthesized molecular recognition unit - heavy CDR3
CNARLSFAGGMGYW

SEQ ID NO: 990 - protein, 12 aa, Artificial Sequence
  Synthesized molecular recognition unit - heavy CDR3
CNAVCKFGTTHW

SEQ ID NO: 991 - protein, 11 aa, Artificial Sequence
  Synthesized molecular recognition unit - heavy CDR3
CNAVNGRLNYW

SEQ ID NO: 992 - protein, 13 aa, Artificial Sequence
  Synthesized molecular recognition unit - heavy CDR3
CNAVSTDWTRDYW

SEQ ID NO: 993 - protein, 12 aa, Artificial Sequence
  Synthesized molecular recognition unit - heavy CDR3
CNAVTYNGYSIW

SEQ ID NO: 994 - protein, 12 aa, Artificial Sequence
  Synthesized molecular recognition unit - heavy CDR3
CNAVTYNGYTIW

SEQ ID NO: 995 - protein, 12 aa, Artificial Sequence
  Synthesized molecular recognition unit - heavy CDR3
CNAVWKFGTTHW

SEQ ID NO: 996 - protein, 18 aa, Artificial Sequence
  Synthesized molecular recognition unit - heavy CDR3
CNAWVLVAGSRGTSADYW

SEQ ID NO: 997 - protein, 12 aa, Artificial Sequence
  Synthesized molecular recognition unit - heavy CDR3
CNGVTYNGYTIW

SEQ ID NO: 998 - protein, 11 aa, Artificial Sequence
  Synthesized molecular recognition unit - heavy CDR3
CNLAQRGETYW

SEQ ID NO: 999 - protein, 16 aa, Artificial Sequence
  Synthesized molecular recognition unit - heavy CDR3
CNMGLGYSEYRPLGYW

SEQ ID NO: 1000 - protein, 19 aa, Artificial Sequence
  Synthesized molecular recognition unit - heavy CDR3
CNMRGNWYREGRPAEFLSW

SEQ ID NO: 1001 - protein, 12 aa, Artificial Sequence
  Synthesized molecular recognition unit - heavy CDR3
CNRVGSREYSYW

SEQ ID NO: 1002 - protein, 11 aa, Artificial Sequence
  Synthesized molecular recognition unit - heavy CDR3
CNSFPLRLHDW

SEQ ID NO: 1003 - protein, 10 aa, Artificial Sequence
  Synthesized molecular recognition unit - heavy CDR3
CNTGIPMLYW

SEQ ID NO: 1004 - protein, 15 aa, Artificial Sequence
  Synthesized molecular recognition unit - heavy CDR3
CNTVTYNAGCYKKYW

SEQ ID NO: 1005 - protein, 15 aa, Artificial Sequence
  Synthesized molecular recognition unit - heavy CDR3
CNTVTYTGGSYKNYW

SEQ ID NO: 1006 - protein, 16 aa, Artificial Sequence
  Synthesized molecular recognition unit - heavy CDR3
CNVITIVRGMGPRAYW

SEQ ID NO: 1007 - protein, 15 aa, Artificial Sequence
  Synthesized molecular recognition unit - heavy CDR3
CNVLAQNDGDYRTYG

SEQ ID NO: 1008 - protein, 15 aa, Artificial Sequence
  Synthesized molecular recognition unit - heavy CDR3
CNVLAQNDGDYRTYW

SEQ ID NO: 1009 - protein, 9 aa, Artificial Sequence
  Synthesized molecular recognition unit - heavy CDR3
CRVDAFDIW

SEQ ID NO: 1010 - protein, 20 aa, Artificial Sequence
  Synthesized molecular recognition unit - heavy CDR3
CSADKLDYLDDQPFKTWDYW

SEQ ID NO: 1011 - protein, 7 aa, Artificial Sequence
  Synthesized molecular recognition unit - heavy CDR3
CTDEESW

SEQ ID NO: 1012 - protein, 20 aa, Artificial Sequence
  Synthesized molecular recognition unit - heavy CDR3
CTILPAAAAGTYYYYGMDVW

SEQ ID NO: 1013 - protein, 13 aa, Artificial Sequence
  Synthesized molecular recognition unit - heavy CDR3
CTRDLYGGYRDYW

SEQ ID NO: 1014 - protein, 13 aa, Artificial Sequence
  Synthesized molecular recognition unit - heavy CDR3
CTRGNWNVGLANW

SEQ ID NO: 1015 - protein, 13 aa, Artificial Sequence
  Synthesized molecular recognition unit - heavy CDR3
CTRGSRIGWFDPW

SEQ ID NO: 1016 - protein, 11 aa, Artificial Sequence
  Synthesized molecular recognition unit - heavy CDR3
CTRPYDAFDIW

SEQ ID NO: 1017 - protein, 13 aa, Artificial Sequence
  Synthesized molecular recognition unit - heavy CDR3
CTRTIVGATPHYW

SEQ ID NO: 1018 - protein, 15 aa, Artificial Sequence
  Synthesized molecular recognition unit - heavy CDR3
CTSSFLTGSQPSGYW

SEQ ID NO: 1019 - protein, 18 aa, Artificial Sequence
  Synthesized molecular recognition unit - heavy CDR3
CTTDLRYDSSGPAAFDIW

SEQ ID NO: 1020 - protein, 12 aa, Artificial Sequence
  Synthesized molecular recognition unit - heavy CDR3
CTTDPLELPWYW

SEQ ID NO: 1021 - protein, 14 aa, Artificial Sequence
  Synthesized molecular recognition unit - heavy CDR3
CTTDRRYSTYFDLW

SEQ ID NO: 1022 - protein, 21 aa, Artificial Sequence
  Synthesized molecular recognition unit - heavy CDR3
CTTGLFPYYRYNWNNDAFDIW

SEQ ID NO: 1023 - protein, 10 aa, Artificial Sequence
  Synthesized molecular recognition unit - heavy CDR3
CTTPNYYDSR

SEQ ID NO: 1024 - protein, 22 aa, Artificial Sequence
  Synthesized molecular recognition unit - heavy CDR3
CTTRTYDSSGYYETQNYYMDVW

SEQ ID NO: 1025 - protein, 19 aa, Artificial Sequence
  Synthesized molecular recognition unit - heavy CDR3
CTTTEYSSSPDYYYGMDVW

SEQ ID NO: 1026 - protein, 10 aa, Artificial Sequence
  Synthesized molecular recognition unit - heavy CDR3
CTTTTVTTSW

SEQ ID NO: 1027 - protein, 12 aa, Artificial Sequence
  Synthesized molecular recognition unit - heavy CDR3
CVKDRAWGFDYW

SEQ ID NO: 1028 - protein, 16 aa, Artificial Sequence
  Synthesized molecular recognition unit - heavy CDR3
CVKFGMNLGYSGYDYW

SEQ ID NO: 1029 - protein, 16 aa, Artificial Sequence
  Synthesized molecular recognition unit - heavy CDR3
CVRDLRPSGDLNFDYW

SEQ ID NO: 1030 - protein, 11 aa, Artificial Sequence
  Synthesized molecular recognition unit - heavy CDR3
CWGGSYYGDYW

SEQ ID NO: 1031 - protein, 18 aa, Artificial Sequence
  Synthesized molecular recognition unit - heavy CDR3
CWTGLLWFGESTDAFDIW

SEQ ID NO: 1032 - protein, 11 aa, Artificial Sequence
  Synthesized molecular recognition unit - heavy CDR3
CYLEGPLDVYW

SEQ ID NO: 1033 - protein, 9 aa, Artificial Sequence
  Synthesized molecular recognition unit - heavy CDR3
NFIKYVFAN

SEQ ID NO: 1034 - protein, 6 aa, Artificial Sequence
  Synthesized molecular recognition unit - heavy CDR3
PRLDYW

SEQ ID NO: 1035 - protein, 14 aa, Artificial Sequence
  Synthesized molecular recognition unit - light CDR1
GLSSGSVSTNYYPS

SEQ ID NO: 1036 - protein, 16 aa, Artificial Sequence
  Synthesized molecular recognition unit - light CDR1
KSSQSLLHSDGKTYLY

SEQ ID NO: 1037 - protein, 17 aa, Artificial Sequence
  Synthesized molecular recognition unit - light CDR1
KSSQSVLYSSNNKNYLA

SEQ ID NO: 1038 - protein, 11 aa, Artificial Sequence
  Synthesized molecular recognition unit - light CDR1
QANQDISNYLN

SEQ ID NO: 1039 - protein, 11 aa, Artificial Sequence
  Synthesized molecular recognition unit - light CDR1
QASHDINIALN

SEQ ID NO: 1040 - protein, 11 aa, Artificial Sequence
  Synthesized molecular recognition unit - light CDR1
QASQDIDNYLN

SEQ ID NO: 1041 - protein, 11 aa, Artificial Sequence
  Synthesized molecular recognition unit - light CDR1
QASQDIGKYLN

SEQ ID NO: 1042 - protein, 11 aa, Artificial Sequence
  Synthesized molecular recognition unit - light CDR1
QASQDIGNYLN

SEQ ID NO: 1043 - protein, 11 aa, Artificial Sequence
  Synthesized molecular recognition unit - light CDR1
QASQDIRNYLN

SEQ ID NO: 1044 - protein, 11 aa, Artificial Sequence
  Synthesized molecular recognition unit - light CDR1
QASQDISHYLN

SEQ ID NO: 1045 - protein, 11 aa, Artificial Sequence
  Synthesized molecular recognition unit - light CDR1
QASQDISNRLN

SEQ ID NO: 1046 - protein, 11 aa, Artificial Sequence
  Synthesized molecular recognition unit - light CDR1
QASQDISNYLN

SEQ ID NO: 1047 - protein, 11 aa, Artificial Sequence
  Synthesized molecular recognition unit - light CDR1
QASQDISSYLN

SEQ ID NO: 1048 - protein, 11 aa, Artificial Sequence
  Synthesized molecular recognition unit - light CDR1
QASQDITNYLN

SEQ ID NO: 1049 - protein, 11 aa, Artificial Sequence
  Synthesized molecular recognition unit - light CDR1
QASQGISNNLN

SEQ ID NO: 1050 - protein, 11 aa, Artificial Sequence
  Synthesized molecular recognition unit - light CDR1
QASQGISNYLN

SEQ ID NO: 1051 - protein, 11 aa, Artificial Sequence
  Synthesized molecular recognition unit - light CDR1
QATQNIKKYLN

SEQ ID NO: 1052 - protein, 11 aa, Artificial Sequence
  Synthesized molecular recognition unit - light CDR1
QGDSLRTYYAS

SEQ ID NO: 1053 - protein, 11 aa, Artificial Sequence
  Synthesized molecular recognition unit - light CDR1
QTSQDINNNLN

SEQ ID NO: 1054 - protein, 11 aa, Artificial Sequence
  Synthesized molecular recognition unit - light CDR1
RAIQSISSYLN

SEQ ID NO: 1055 - protein, 11 aa, Artificial Sequence
  Synthesized molecular recognition unit - light CDR1
RASESVSSNLA

SEQ ID NO: 1056 - protein, 12 aa, Artificial Sequence
  Synthesized molecular recognition unit - light CDR1
RASESVSSSSFA

SEQ ID NO: 1057 - protein, 11 aa, Artificial Sequence
  Synthesized molecular recognition unit - light CDR1
RASHDIGTFLA

SEQ ID NO: 1058 - protein, 11 aa, Artificial Sequence
  Synthesized molecular recognition unit - light CDR1
RASQAISNSLA

SEQ ID NO: 1059 - protein, 11 aa, Artificial Sequence
  Synthesized molecular recognition unit - light CDR1
RASQAISNYLN

SEQ ID NO: 1060 - protein, 11 aa, Artificial Sequence
  Synthesized molecular recognition unit - light CDR1
RASQAISSYLA

SEQ ID NO: 1061 - protein, 11 aa, Artificial Sequence
  Synthesized molecular recognition unit - light CDR1
RASQDIGSFLA

SEQ ID NO: 1062 - protein, 11 aa, Artificial Sequence
  Synthesized molecular recognition unit - light CDR1
RASQDIRDELA

SEQ ID NO: 1063 - protein, 11 aa, Artificial Sequence
  Synthesized molecular recognition unit - light CDR1
RASQDIRSALA

SEQ ID NO: 1064 - protein, 11 aa, Artificial Sequence
  Synthesized molecular recognition unit - light CDR1
RASQDISSWLA

SEQ ID NO: 1065 - protein, 11 aa, Artificial Sequence
  Synthesized molecular recognition unit - light CDR1
RASQDISSYLA

SEQ ID NO: 1066 - protein, 11 aa, Artificial Sequence
  Synthesized molecular recognition unit - light CDR1
RASQDVDTWLA

SEQ ID NO: 1067 - protein, 11 aa, Artificial Sequence
  Synthesized molecular recognition unit - light CDR1
RASQGINNYLA

SEQ ID NO: 1068 - protein, 11 aa, Artificial Sequence
  Synthesized molecular recognition unit - light CDR1
RASQGIRNDLA

SEQ ID NO: 1069 - protein, 11 aa, Artificial Sequence
  Synthesized molecular recognition unit - light CDR1
RASQGIRNDLG

SEQ ID NO: 1070 - protein, 11 aa, Artificial Sequence
  Synthesized molecular recognition unit - light CDR1
RASQGIRSDLA

SEQ ID NO: 1071 - protein, 11 aa, Artificial Sequence
  Synthesized molecular recognition unit - light CDR1
RASQGISNNIN

SEQ ID NO: 1072 - protein, 11 aa, Artificial Sequence
  Synthesized molecular recognition unit - light CDR1
RASQGISNNLN

SEQ ID NO: 1073 - protein, 11 aa, Artificial Sequence
  Synthesized molecular recognition unit - light CDR1
RASQGISNWLA

SEQ ID NO: 1074 - protein, 11 aa, Artificial Sequence
  Synthesized molecular recognition unit - light CDR1
RASQGISNYLA

SEQ ID NO: 1075 - protein, 11 aa, Artificial Sequence
  Synthesized molecular recognition unit - light CDR1
RASQGISRTLZ

SEQ ID NO: 1076 - protein, 11 aa, Artificial Sequence
  Synthesized molecular recognition unit - light CDR1
RASQGISSALA

SEQ ID NO: 1077 - protein, 11 aa, Artificial Sequence
  Synthesized molecular recognition unit - light CDR1
RASQGITKSLA

SEQ ID NO: 1078 - protein, 11 aa, Artificial Sequence
  Synthesized molecular recognition unit - light CDR1
RASQGVGDYLA

SEQ ID NO: 1079 - protein, 11 aa, Artificial Sequence
  Synthesized molecular recognition unit - light CDR1
RASQGVSTZLS

SEQ ID NO: 1080 - protein, 11 aa, Artificial Sequence
  Synthesized molecular recognition unit - light CDR1
RASQNIGSRLA

SEQ ID NO: 1081 - protein, 11 aa, Artificial Sequence
  Synthesized molecular recognition unit - light CDR1
RASQNINNYLA

SEQ ID NO: 1082 - protein, 11 aa, Artificial Sequence
  Synthesized molecular recognition unit - light CDR1
RASQNVNDWLA

SEQ ID NO: 1083 - protein, 11 aa, Artificial Sequence
  Synthesized molecular recognition unit - light CDR1
RASQRVGNNLA

SEQ ID NO: 1084 - protein, 11 aa, Artificial Sequence
  Synthesized molecular recognition unit - light CDR1
RASQSIGRWLA

SEQ ID NO: 1085 - protein, 11 aa, Artificial Sequence
  Synthesized molecular recognition unit - light CDR1
RASQSIGSNLD

SEQ ID NO: 1086 - protein, 11 aa, Artificial Sequence
  Synthesized molecular recognition unit - light CDR1
RASQSIGSNLN

SEQ ID NO: 1087 - protein, 11 aa, Artificial Sequence
  Synthesized molecular recognition unit - light CDR1
RASQSIGSSLH

SEQ ID NO: 1088 - protein, 11 aa, Artificial Sequence
  Synthesized molecular recognition unit - light CDR1
RASQSIGTYLN

SEQ ID NO: 1089 - protein, 12 aa, Artificial Sequence
  Synthesized molecular recognition unit - light CDR1
RASQSINRNYLG

SEQ ID NO: 1090 - protein, 11 aa, Artificial Sequence
  Synthesized molecular recognition unit - light CDR1
RASQSINRWLA

SEQ ID NO: 1091 - protein, 11 aa, Artificial Sequence
  Synthesized molecular recognition unit - light CDR1
RASQSINSNLA

SEQ ID NO: 1092 - protein, 11 aa, Artificial Sequence
  Synthesized molecular recognition unit - light CDR1
RASQSISNNLN

SEQ ID NO: 1093 - protein, 11 aa, Artificial Sequence
  Synthesized molecular recognition unit - light CDR1
RASQSISRSLA

SEQ ID NO: 1094 - protein, 11 aa, Artificial Sequence
  Synthesized molecular recognition unit - light CDR1
RASQSISRWLA

SEQ ID NO: 1095 - protein, 11 aa, Artificial Sequence
  Synthesized molecular recognition unit - light CDR1
RASQSISRYLN

SEQ ID NO: 1096 - protein, 11 aa, Artificial Sequence
  Synthesized molecular recognition unit - light CDR1
RASQSISSHZN

SEQ ID NO: 1097 - protein, 12 aa, Artificial Sequence
  Synthesized molecular recognition unit - light CDR1
RASQSISSKSLA

SEQ ID NO: 1098 - protein, 11 aa, Artificial Sequence
  Synthesized molecular recognition unit - light CDR1
RASQSISSYLN

SEQ ID NO: 1099 - protein, 11 aa, Artificial Sequence
  Synthesized molecular recognition unit - light CDR1
RASQSISTNVN

SEQ ID NO: 1100 - protein, 11 aa, Artificial Sequence
  Synthesized molecular recognition unit - light CDR1
RASQSISTYLA

SEQ ID NO: 1101 - protein, 11 aa, Artificial Sequence
  Synthesized molecular recognition unit - light CDR1
RASQSISTYLS

SEQ ID NO: 1102 - protein, 11 aa, Artificial Sequence
  Synthesized molecular recognition unit - light CDR1
RASQSISZWLA

SEQ ID NO: 1103 - protein, 11 aa, Artificial Sequence
  Synthesized molecular recognition unit - light CDR1
RASQSISZYZN

SEQ ID NO: 1104 - protein, 11 aa, Artificial Sequence
  Synthesized molecular recognition unit - light CDR1
RASQSIVSYLN

SEQ ID NO: 1105 - protein, 11 aa, Artificial Sequence
  Synthesized molecular recognition unit - light CDR1
RASQSIZZYZN

SEQ ID NO: 1106 - protein, 11 aa, Artificial Sequence
  Synthesized molecular recognition unit - light CDR1
RASQSLRSKLA

SEQ ID NO: 1107 - protein, 11 aa, Artificial Sequence
  Synthesized molecular recognition unit - light CDR1
RASQSVGRWMA

SEQ ID NO: 1108 - protein, 11 aa, Artificial Sequence
  Synthesized molecular recognition unit - light CDR1
RASQSVGSNLA

SEQ ID NO: 1109 - protein, 11 aa, Artificial Sequence
  Synthesized molecular recognition unit - light CDR1
RASQSVGSYLA

SEQ ID NO: 1110 - protein, 11 aa, Artificial Sequence
  Synthesized molecular recognition unit - light CDR1
RASQSVGTYLT

SEQ ID NO: 1111 - protein, 12 aa, Artificial Sequence
  Synthesized molecular recognition unit - light CDR1
RASQSVNNTYVA

SEQ ID NO: 1112 - protein, 11 aa, Artificial Sequence
  Synthesized molecular recognition unit - light CDR1
RASQSVSGYLA

SEQ ID NO: 1113 - protein, 11 aa, Artificial Sequence
  Synthesized molecular recognition unit - light CDR1
RASQSVSRKLA

SEQ ID NO: 1114 - protein, 11 aa, Artificial Sequence
  Synthesized molecular recognition unit - light CDR1
RASQSVSRNLA

SEQ ID NO: 1115 - protein, 11 aa, Artificial Sequence
  Synthesized molecular recognition unit - light CDR1
RASQSVSSDLA

SEQ ID NO: 1116 - protein, 11 aa, Artificial Sequence
  Synthesized molecular recognition unit - light CDR1
RASQSVSSNLA

SEQ ID NO: 1117 - protein, 12 aa, Artificial Sequence
  Synthesized molecular recognition unit - light CDR1
RASQSVSSNQLA

SEQ ID NO: 1118 - protein, 12 aa, Artificial Sequence
  Synthesized molecular recognition unit - light CDR1
RASQSVSSNYLS

SEQ ID NO: 1119 - protein, 12 aa, Artificial Sequence
  Synthesized molecular recognition unit - light CDR1
RASQSVSSSYLS

SEQ ID NO: 1120 - protein, 11 aa, Artificial Sequence
  Synthesized molecular recognition unit - light CDR1
RASQSVSSWLA

SEQ ID NO: 1121 - protein, 11 aa, Artificial Sequence
  Synthesized molecular recognition unit - light CDR1
RASQSVSSYLA

SEQ ID NO: 1122 - protein, 11 aa, Artificial Sequence
  Synthesized molecular recognition unit - light CDR1
RASQSVSTNLA

SEQ ID NO: 1123 - protein, 12 aa, Artificial Sequence
  Synthesized molecular recognition unit - light CDR1
RASQSVSTSYLA

SEQ ID NO: 1124 - protein, 11 aa, Artificial Sequence
  Synthesized molecular recognition unit - light CDR1
RASQSVTSSLA

SEQ ID NO: 1125 - protein, 11 aa, Artificial Sequence
  Synthesized molecular recognition unit - light CDR1
RASQTINNQLA

SEQ ID NO: 1126 - protein, 11 aa, Artificial Sequence
  Synthesized molecular recognition unit - light CDR1
RASQTISRYLN

SEQ ID NO: 1127 - protein, 11 aa, Artificial Sequence
  Synthesized molecular recognition unit - light CDR1
RASQZVSRZZA

SEQ ID NO: 1128 - protein, 11 aa, Artificial Sequence
  Synthesized molecular recognition unit - light CDR1
RASRSISSYFN

SEQ ID NO: 1129 - protein, 11 aa, Artificial Sequence
  Synthesized molecular recognition unit - light CDR1
RATQTISTYLN

SEQ ID NO: 1130 - protein, 16 aa, Artificial Sequence
  Synthesized molecular recognition unit - light CDR1
RSSESLLHSDGKTYLY

SEQ ID NO: 1131 - protein, 11 aa, Artificial Sequence
  Synthesized molecular recognition unit - light CDR1
RSSQNIFQSLN

SEQ ID NO: 1132 - protein, 11 aa, Artificial Sequence
  Synthesized molecular recognition unit - light CDR1
RSSQNVSSYLA

SEQ ID NO: 1133 - protein, 17 aa, Artificial Sequence
  Synthesized molecular recognition unit - light CDR1
RSSQSLLDSDDGNTYLD

SEQ ID NO: 1134 - protein, 16 aa, Artificial Sequence
  Synthesized molecular recognition unit - light CDR1
RSSQSLLHSDGKTYLY

SEQ ID NO: 1135 - protein, 16 aa, Artificial Sequence
  Synthesized molecular recognition unit - light CDR1
RSSQSLLHSDGYTYLY

SEQ ID NO: 1136 - protein, 16 aa, Artificial Sequence
  Synthesized molecular recognition unit - light CDR1
RSSQSLLHSNGFNYVD

SEQ ID NO: 1137 - protein, 16 aa, Artificial Sequence
  Synthesized molecular recognition unit - light CDR1
RSSQSLLHSNGNTYLD

SEQ ID NO: 1138 - protein, 16 aa, Artificial Sequence
  Synthesized molecular recognition unit - light CDR1
RSSQSLLHSNGYNYLD

SEQ ID NO: 1139 - protein, 16 aa, Artificial Sequence
  Synthesized molecular recognition unit - light CDR1
RSSQSLLRRNGHNYVD

SEQ ID NO: 1140 - protein, 16 aa, Artificial Sequence
  Synthesized molecular recognition unit - light CDR1
RSSQSLVHSDGNTYLS

SEQ ID NO: 1141 - protein, 12 aa, Artificial Sequence
  Synthesized molecular recognition unit - light CDR1
RSSQYLSSAYLA

SEQ ID NO: 1142 - protein, 17 aa, Artificial Sequence
  Synthesized molecular recognition unit - light CDR1
RSSRSLLDTDDGNTYLD

SEQ ID NO: 1143 - protein, 16 aa, Artificial Sequence
  Synthesized molecular recognition unit - light CDR1
RSSRSLLHSDGKTYLY

SEQ ID NO: 1144 - protein, 16 aa, Artificial Sequence
  Synthesized molecular recognition unit - light CDR1
RSSRSLLHSNGNTYLQ

SEQ ID NO: 1145 - protein, 16 aa, Artificial Sequence
  Synthesized molecular recognition unit - light CDR1
RSSRSLLHSNGNTYLR

SEQ ID NO: 1146 - protein, 16 aa, Artificial Sequence
  Synthesized molecular recognition unit - light CDR1
RSSRSLLHTNGYNYLD

SEQ ID NO: 1147 - protein, 16 aa, Artificial Sequence
  Synthesized molecular recognition unit - light CDR1
RSSRSLLHTSGYNYLD

SEQ ID NO: 1148 - protein, 12 aa, Artificial Sequence
  Synthesized molecular recognition unit - light CDR1
RTSERSSISSFA

SEQ ID NO: 1149 - protein, 11 aa, Artificial Sequence
  Synthesized molecular recognition unit - light CDR1
RTSQSISSYLN

SEQ ID NO: 1150 - protein, 11 aa, Artificial Sequence
  Synthesized molecular recognition unit - light CDR1
RTSQSVSSNLA

SEQ ID NO: 1151 - protein, 11 aa, Artificial Sequence
  Synthesized molecular recognition unit - light CDR1
RVSQGISSALA

SEQ ID NO: 1152 - protein, 11 aa, Artificial Sequence
  Synthesized molecular recognition unit - light CDR1
SGDKLGKKYAS

SEQ ID NO: 1153 - protein, 11 aa, Artificial Sequence
  Synthesized molecular recognition unit - light CDR1
SGDNIGSFYVH

SEQ ID NO: 1154 - protein, 11 aa, Artificial Sequence
  Synthesized molecular recognition unit - light CDR1
SGDKVGHKYAS

SEQ ID NO: 1155 - protein, 11 aa, Artificial Sequence
  Synthesized molecular recognition unit - light CDR1
SGNTLGSHYVS

SEQ ID NO: 1156 - protein, 13 aa, Artificial Sequence
  Synthesized molecular recognition unit - light CDR1
SGSSSNIGSHTVS

SEQ ID NO: 1157 - protein, 14 aa, Artificial Sequence
  Synthesized molecular recognition unit - light CDR1
SGTSSNIGAGYDVH

SEQ ID NO: 1158 - protein, 14 aa, Artificial Sequence
  Synthesized molecular recognition unit - light CDR1
TGSSSNIGAGFGVH

SEQ ID NO: 1159 - protein, 14 aa, Artificial Sequence
  Synthesized molecular recognition unit - light CDR1
TGTSSDVGGYNSVS

SEQ ID NO: 1160 - protein, 13 aa, Artificial Sequence
  Synthesized molecular recognition unit - light CDR1
TRSSGSIASNYVQ

SEQ ID NO: 1161 - protein, 14 aa, Artificial Sequence
  Synthesized molecular recognition unit - light CDR1
TRSSSNIGAGYDVH

SEQ ID NO: 1162 - protein, 16 aa, Artificial Sequence
  Synthesized molecular recognition unit - light CDR1
TSSQSLLHSDGKTYLY

SEQ ID NO: 1163 - protein, 11 aa, Artificial Sequence
  Synthesized molecular recognition unit - light CDR1
ZACLRIISYLN

SEQ ID NO: 1164 - protein, 11 aa, Artificial Sequence
  Synthesized molecular recognition unit - light CDR1
ZPZQTZZSHLN

SEQ ID NO: 1165 - protein, 7 aa, Artificial Sequence
  Synthesized molecular recognition unit - light CDR2
AASALQS

SEQ ID NO: 1166 - protein, 7 aa, Artificial Sequence
  Synthesized molecular recognition unit - light CDR2
AASNLET

SEQ ID NO: 1167 - protein, 7 aa, Artificial Sequence
  Synthesized molecular recognition unit - light CDR2
AASNLLG

SEQ ID NO: 1168 - protein, 7 aa, Artificial Sequence
  Synthesized molecular recognition unit - light CDR2
AASNLQL

SEQ ID NO: 1169 - protein, 7 aa, Artificial Sequence
  Synthesized molecular recognition unit - light CDR2
AASNLQS

SEQ ID NO: 1170 - protein, 7 aa, Artificial Sequence
  Synthesized molecular recognition unit - light CDR2
AASRLES

SEQ ID NO: 1171 - protein, 7 aa, Artificial Sequence
  Synthesized molecular recognition unit - light CDR2
AASRLQS

SEQ ID NO: 1172 - protein, 7 aa, Artificial Sequence
  Synthesized molecular recognition unit - light CDR2
AASRRAT

SEQ ID NO: 1173 - protein, 7 aa, Artificial Sequence
  Synthesized molecular recognition unit - light CDR2
AASSLHT

SEQ ID NO: 1174 - protein, 7 aa, Artificial Sequence
  Synthesized molecular recognition unit - light CDR2
AASSLQR

SEQ ID NO: 1175 - protein, 7 aa, Artificial Sequence
  Synthesized molecular recognition unit - light CDR2
AASSLQS

SEQ ID NO: 1176 - protein, 7 aa, Artificial Sequence
  Synthesized molecular recognition unit - light CDR2
AASSRVT

SEQ ID NO: 1177 - protein, 7 aa, Artificial Sequence
  Synthesized molecular recognition unit - light CDR2
AASTLES

SEQ ID NO: 1178 - protein, 7 aa, Artificial Sequence
  Synthesized molecular recognition unit - light CDR2
AASTLET

SEQ ID NO: 1179 - protein, 7 aa, Artificial Sequence
  Synthesized molecular recognition unit - light CDR2
AASTLQS

SEQ ID NO: 1180 - protein, 7 aa, Artificial Sequence
  Synthesized molecular recognition unit - light CDR2
AASTLQT

SEQ ID NO: 1181 - protein, 7 aa, Artificial Sequence
  Synthesized molecular recognition unit - light CDR2
AASTSQS

SEQ ID NO: 1182 - protein, 7 aa, Artificial Sequence
  Synthesized molecular recognition unit - light CDR2
ASSTLQT

SEQ ID NO: 1183 - protein, 7 aa, Artificial Sequence
  Synthesized molecular recognition unit - light CDR2
ATSTLQS

SEQ ID NO: 1184 - protein, 7 aa, Artificial Sequence
  Synthesized molecular recognition unit - light CDR2
DASIRAT

SEQ ID NO: 1185 - protein, 7 aa, Artificial Sequence
  Synthesized molecular recognition unit - light CDR2
DASNLET

SEQ ID NO: 1186 - protein, 7 aa, Artificial Sequence
  Synthesized molecular recognition unit - light CDR2
DASNLQS

SEQ ID NO: 1187 - protein, 7 aa, Artificial Sequence
  Synthesized molecular recognition unit - light CDR2
DASNRAS

SEQ ID NO: 1188 - protein, 7 aa, Artificial Sequence
  Synthesized molecular recognition unit - light CDR2
DASNRAT

SEQ ID NO: 1189 - protein, 7 aa, Artificial Sequence
  Synthesized molecular recognition unit - light CDR2
DASSLES

SEQ ID NO: 1190 - protein, 7 aa, Artificial Sequence
  Synthesized molecular recognition unit - light CDR2
DASSLQS

SEQ ID NO: 1191 - protein, 7 aa, Artificial Sequence
  Synthesized molecular recognition unit - light CDR2
DASTLET

SEQ ID NO: 1192 - protein, 7 aa, Artificial Sequence
  Synthesized molecular recognition unit - light CDR2
DASTLKR

SEQ ID NO: 1193 - protein, 7 aa, Artificial Sequence
  Synthesized molecular recognition unit - light CDR2
DASTLQT

SEQ ID NO: 1194 - protein, 7 aa, Artificial Sequence
  Synthesized molecular recognition unit - light CDR2
DTSNRAT

SEQ ID NO: 1195 - protein, 7 aa, Artificial Sequence
  Synthesized molecular recognition unit - light CDR2
DVSNLER

SEQ ID NO: 1196 - protein, 7 aa, Artificial Sequence
  Synthesized molecular recognition unit - light CDR2
DVTKRPS

SEQ ID NO: 1197 - protein, 7 aa, Artificial Sequence
  Synthesized molecular recognition unit - light CDR2
EASSVAS

SEQ ID NO: 1198 - protein, 7 aa, Artificial Sequence
  Synthesized molecular recognition unit - light CDR2
EASTLQS

SEQ ID NO: 1199 - protein, 7 aa, Artificial Sequence
  Synthesized molecular recognition unit - light CDR2
EDSQRPS

SEQ ID NO: 1200 - protein, 8 aa, Artificial Sequence
  Synthesized molecular recognition unit - light CDR2
EKDNRPSG

SEQ ID NO: 1201 - protein, 8 aa, Artificial Sequence
  Synthesized molecular recognition unit - light CDR2
DKSNRPSG

SEQ ID NO: 1202 - protein, 7 aa, Artificial Sequence
  Synthesized molecular recognition unit - light CDR2
ENDKRPS

SEQ ID NO: 1203 - protein, 7 aa, Artificial Sequence
  Synthesized molecular recognition unit - light CDR2
EVSSLQG

SEQ ID NO: 1204 - protein, 7 aa, Artificial Sequence
  Synthesized molecular recognition unit - light CDR2
EVSSVQG

SEQ ID NO: 1205 - protein, 7 aa, Artificial Sequence
  Synthesized molecular recognition unit - light CDR2
FASSLQS

SEQ ID NO: 1206 - protein, 7 aa, Artificial Sequence
  Synthesized molecular recognition unit - light CDR2
FGSYRAS

SEQ ID NO: 1207 - protein, 7 aa, Artificial Sequence
  Synthesized molecular recognition unit - light CDR2
GASNLQS

SEQ ID NO: 1208 - protein, 7 aa, Artificial Sequence
  Synthesized molecular recognition unit - light CDR2
GASNRAS

SEQ ID NO: 1209 - protein, 7 aa, Artificial Sequence
  Synthesized molecular recognition unit - light CDR2
GASNRPT

SEQ ID NO: 1210 - protein, 7 aa, Artificial Sequence
  Synthesized molecular recognition unit - light CDR2
GASSLES

SEQ ID NO: 1211 - protein, 7 aa, Artificial Sequence
  Synthesized molecular recognition unit - light CDR2
GASSLQS

SEQ ID NO: 1212 - protein, 7 aa, Artificial Sequence
  Synthesized molecular recognition unit - light CDR2
GASSRAP

SEQ ID NO: 1213 - protein, 7 aa, Artificial Sequence
  Synthesized molecular recognition unit - light CDR2
GASSRAT

SEQ ID NO: 1214 - protein, 7 aa, Artificial Sequence
  Synthesized molecular recognition unit - light CDR2
GASTLQR

SEQ ID NO: 1215 - protein, 7 aa, Artificial Sequence
  Synthesized molecular recognition unit - light CDR2
GASTLQS

SEQ ID NO: 1216 - protein, 7 aa, Artificial Sequence
  Synthesized molecular recognition unit - light CDR2
GASTRAA

SEQ ID NO: 1217 - protein, 7 aa, Artificial Sequence
  Synthesized molecular recognition unit - light CDR2
GASTRAT

SEQ ID NO: 1218 - protein, 7 aa, Artificial Sequence
  Synthesized molecular recognition unit - light CDR2
GASTVES

SEQ ID NO: 1219 - protein, 7 aa, Artificial Sequence
  Synthesized molecular recognition unit - light CDR2
GKNNRPS

SEQ ID NO: 1220 - protein, 7 aa, Artificial Sequence
  Synthesized molecular recognition unit - light CDR2
GNSIRPS

SEQ ID NO: 1221 - protein, 7 aa, Artificial Sequence
  Synthesized molecular recognition unit - light CDR2
GSSNRAA

SEQ ID NO: 1222 - protein, 7 aa, Artificial Sequence
  Synthesized molecular recognition unit - light CDR2
GTSTRAT

SEQ ID NO: 1223 - protein, 7 aa, Artificial Sequence
  Synthesized molecular recognition unit - light CDR2
GVSNRAT

SEQ ID NO: 1224 - protein, 7 aa, Artificial Sequence
  Synthesized molecular recognition unit - light CDR2
KASNLET

SEQ ID NO: 1225 - protein, 7 aa, Artificial Sequence
  Synthesized molecular recognition unit - light CDR2
KASSLEN

SEQ ID NO: 1226 - protein, 7 aa, Artificial Sequence
  Synthesized molecular recognition unit - light CDR2
KASSLES

SEQ ID NO: 1227 - protein, 7 aa, Artificial Sequence
  Synthesized molecular recognition unit - light CDR2
KASSLQS

SEQ ID NO: 1228 - protein, 7 aa, Artificial Sequence
  Synthesized molecular recognition unit - light CDR2
KASTLDT

SEQ ID NO: 1229 - protein, 7 aa, Artificial Sequence
  Synthesized molecular recognition unit - light CDR2
KASTLES

SEQ ID NO: 1230 - protein, 7 aa, Artificial Sequence
  Synthesized molecular recognition unit - light CDR2
KISNRFS

SEQ ID NO: 1231 - protein, 7 aa, Artificial Sequence
  Synthesized molecular recognition unit - light CDR2
LASRRAS

SEQ ID NO: 1232 - protein, 7 aa, Artificial Sequence
  Synthesized molecular recognition unit - light CDR2
LGFNRAS

SEQ ID NO: 1233 - protein, 7 aa, Artificial Sequence
  Synthesized molecular recognition unit - light CDR2
LGSDRAS

SEQ ID NO: 1234 - protein, 7 aa, Artificial Sequence
  Synthesized molecular recognition unit - light CDR2
LGSDRTS

SEQ ID NO: 1235 - protein, 7 aa, Artificial Sequence
  Synthesized molecular recognition unit - light CDR2
LGSHRAS

SEQ ID NO: 1236 - protein, 7 aa, Artificial Sequence
  Synthesized molecular recognition unit - light CDR2
LGSKRAS

SEQ ID NO: 1237 - protein, 7 aa, Artificial Sequence
  Synthesized molecular recognition unit - light CDR2
LGSNRAS

SEQ ID NO: 1238 - protein, 7 aa, Artificial Sequence
  Synthesized molecular recognition unit - light CDR2
MGSNRAP

SEQ ID NO: 1239 - protein, 7 aa, Artificial Sequence
  Synthesized molecular recognition unit - light CDR2
MGSYRAS

SEQ ID NO: 1240 - protein, 7 aa, Artificial Sequence
  Synthesized molecular recognition unit - light CDR2
MLSSRAP

SEQ ID NO: 1241 - protein, 7 aa, Artificial Sequence
  Synthesized molecular recognition unit - light CDR2
NTSNRAT

SEQ ID NO: 1242 - protein, 7 aa, Artificial Sequence
  Synthesized molecular recognition unit - light CDR2
PASSLQS

SEQ ID NO: 1243 - protein, 7 aa, Artificial Sequence
  Synthesized molecular recognition unit - light CDR2
QASNLES

SEQ ID NO: 1244 - protein, 7 aa, Artificial Sequence
  Synthesized molecular recognition unit - light CDR2
QASSLDS

SEQ ID NO: 1245 - protein, 7 aa, Artificial Sequence
  Synthesized molecular recognition unit - light CDR2
QASSLIS

SEQ ID NO: 1246 - protein, 7 aa, Artificial Sequence
  Synthesized molecular recognition unit - light CDR2
QDSKRPS

SEQ ID NO: 1247 - protein, 7 aa, Artificial Sequence
  Synthesized molecular recognition unit - light CDR2
RASSLQS

SEQ ID NO: 1248 - protein, 7 aa, Artificial Sequence
  Synthesized molecular recognition unit - light CDR2
RASTLES

SEQ ID NO: 1249 - protein, 7 aa, Artificial Sequence
  Synthesized molecular recognition unit - light CDR2
RASTLQS

SEQ ID NO: 1250 - protein, 7 aa, Artificial Sequence
  Synthesized molecular recognition unit - light CDR2
RTSTLES

SEQ ID NO: 1251 - protein, 7 aa, Artificial Sequence
  Synthesized molecular recognition unit - light CDR2
RVSSRFS

SEQ ID NO: 1252 - protein, 7 aa, Artificial Sequence
  Synthesized molecular recognition unit - light CDR2
SASNLQS

SEQ ID NO: 1253 - protein, 7 aa, Artificial Sequence
  Synthesized molecular recognition unit - light CDR2
SASRLQI

SEQ ID NO: 1254 - protein, 7 aa, Artificial Sequence
  Synthesized molecular recognition unit - light CDR2
SASSLQS

SEQ ID NO: 1255 - protein, 7 aa, Artificial Sequence
  Synthesized molecular recognition unit - light CDR2
SDRNRPS

SEQ ID NO: 1256 - protein, 7 aa, Artificial Sequence
  Synthesized molecular recognition unit - light CDR2
SNYQRPS

SEQ ID NO: 1257 - protein, 7 aa, Artificial Sequence
  Synthesized molecular recognition unit - light CDR2
STNTRSS

SEQ ID NO: 1258 - protein, 7 aa, Artificial Sequence
  Synthesized molecular recognition unit - light CDR2
TASSLQS

SEQ ID NO: 1259 - protein, 7 aa, Artificial Sequence
  Synthesized molecular recognition unit - light CDR2
TLSHRAS

SEQ ID NO: 1260 - protein, 7 aa, Artificial Sequence
  Synthesized molecular recognition unit - light CDR2
YASQSVS

SEQ ID NO: 1261 - protein, 7 aa, Artificial Sequence
  Synthesized molecular recognition unit - light CDR2
YASSLQN

SEQ ID NO: 1262 - protein, 7 aa, Artificial Sequence
  Synthesized molecular recognition unit - light CDR2
YASSLQS

SEQ ID NO: 1263 - protein, 7 aa, Artificial Sequence
  Synthesized molecular recognition unit - light CDR2
YTNTRSS

SEQ ID NO: 1264 - protein, 7 aa, Artificial Sequence
  Synthesized molecular recognition unit - light CDR2
ZASSLQS

SEQ ID NO: 1265 - protein, 14 aa, Artificial Sequence
  Synthesized molecular recognition unit - light CDR3
CAAWDGSLFGHWVF

SEQ ID NO: 1266 - protein, 9 aa, Artificial Sequence
  Synthesized molecular recognition unit - light CDR3
CFSYAGSRF

SEQ ID NO: 1267 - protein, 13 aa, Artificial Sequence [sequence omitted]

SEQ ID NO: 1268 - protein, 11 aa, Artificial Sequence
  Synthesized molecular recognition unit - light CDR3
CHQSGRVPVTF

SEQ ID NO: 1269 - protein, 11 aa, Artificial Sequence [sequence omitted]

SEQ ID NO: 1270 - protein, 11 aa, Artificial Sequence
  Synthesized molecular recognition unit - light CDR3
CIQNTHWPLTR

SEQ ID NO: 1271 - protein, 12 aa, Artificial Sequence
  Synthesized molecular recognition unit - light CDR3
CLLYLGRGIWVF

SEQ ID NO: 1272 - protein, 11 aa, Artificial Sequence [sequence omitted]

SEQ ID NO: 1273 - protein, 11 aa, Artificial Sequence [sequence omitted]

SEQ ID NO: 1274 - protein, 11 aa, Artificial Sequence [sequence omitted]

SEQ ID NO: 1275 - protein, 11 aa, Artificial Sequence [sequence omitted]

SEQ ID NO: 1276 - protein, 10 aa, Artificial Sequence
  Synthesized molecular recognition unit - light CDR3
CLQHKSFPTF

SEQ ID NO: 1277 - protein, 11 aa, Artificial Sequence
  Synthesized molecular recognition unit - light CDR3
CLQHNGYPITF

SEQ ID NO: 1278 - protein, 11 aa, Artificial Sequence
  Synthesized molecular recognition unit - light CDR3
CLQHNSLPFTF

SEQ ID NO: 1279 - protein, 11 aa, Artificial Sequence
  Synthesized molecular recognition unit - light CDR3
CMHGLHPPFTF

SEQ ID NO: 1280 - protein, 11 aa, Artificial Sequence [sequence omitted]

SEQ ID NO: 1281 - protein, 11 aa, Artificial Sequence [sequence omitted]

SEQ ID NO: 1282 - protein, 11 aa, Artificial Sequence [sequence omitted]

SEQ ID NO: 1283 - protein, 11 aa, Artificial Sequence [sequence omitted]

SEQ ID NO: 1284 - protein, 11 aa, Artificial Sequence [sequence omitted]

SEQ ID NO: 1285 - protein, 11 aa, Artificial Sequence [sequence omitted]

SEQ ID NO: 1286 - protein, 11 aa, Artificial Sequence [sequence omitted]

SEQ ID NO: 1287 - protein, 11 aa, Artificial Sequence [sequence omitted]

SEQ ID NO: 1288 - protein, 11 aa, Artificial Sequence [sequence omitted]

SEQ ID NO: 1289 - protein, 11 aa, Artificial Sequence [sequence omitted]

SEQ ID NO: 1290 - protein, 10 aa, Artificial Sequence [sequence omitted]

SEQ ID NO: 1291 - protein, 11 aa, Artificial Sequence [sequence omitted]

SEQ ID NO: 1292 - protein, 11 aa, Artificial Sequence
  Synthesized molecular recognition unit - light CDR3
CMQNTHWPLTL

SEQ ID NO: 1293 - protein, 11 aa, Artificial Sequence
  Synthesized molecular recognition unit - light CDR3
CMQNTHWPLTR

SEQ ID NO: 1294 - protein, 11 aa, Artificial Sequence [sequence omitted]

SEQ ID NO: 1295 - protein, 11 aa, Artificial Sequence [sequence omitted]

SEQ ID NO: 1296 - protein, 11 aa, Artificial Sequence
  Synthesized molecular recognition unit - light CDR3
CMQSLQSPLTF

SEQ ID NO: 1297 - protein, 11 aa, Artificial Sequence [sequence omitted]

SEQ ID NO: 1298 - protein, 11 aa, Artificial Sequence
  Synthesized molecular recognition unit - light CDR3
CMQSSHWPKTF

SEQ ID NO: 1299 - protein, 11 aa, Artificial Sequence
  Synthesized molecular recognition unit - light CDR3
CMQTLKAPLTF

SEQ ID NO: 1300 - protein, 13 aa, Artificial Sequence
  Synthesized molecular recognition unit - light CDR3
CNSRDNSGKHKVF

SEQ ID NO: 1301 - protein, 12 aa, Artificial Sequence [sequence omitted]

SEQ ID NO: 1302 - protein, 11 aa, Artificial Sequence [sequence omitted]

SEQ ID NO: 1303 - protein, 11 aa, Artificial Sequence
  Synthesized molecular recognition unit - light CDR3
CQHLNNFPLTF

SEQ ID NO: 1304 - protein, 13 aa, Artificial Sequence
  Synthesized molecular recognition unit - light CDR3
CQHLNSYPPGDTF

SEQ ID NO: 1305 - protein, 11 aa, Artificial Sequence
  Synthesized molecular recognition unit - light CDR3
CQHRANWPQTF

SEQ ID NO: 1306 - protein, 7 aa, Artificial Sequence
  Synthesized molecular recognition unit - light CDR3
CQHRNFF

SEQ ID NO: 1307 - protein, 11 aa, Artificial Sequence
  Synthesized molecular recognition unit - light CDR3
CQHRTSWPLTF

SEQ ID NO: 1308 - protein, 11 aa, Artificial Sequence [sequence omitted]

SEQ ID NO: 1309 - protein, 11 aa, Artificial Sequence [sequence omitted]

SEQ ID NO: 1310 - protein, 11 aa, Artificial Sequence [sequence omitted]

SEQ ID NO: 1311 - protein, 11 aa, Artificial Sequence [sequence omitted]

SEQ ID NO: 1312 - protein, 11 aa, Artificial Sequence [sequence omitted]

SEQ ID NO: 1313 - protein, 11 aa, Artificial Sequence
  Synthesized molecular recognition unit - light CDR3
CQQADTFPFTF

SEQ ID NO: 1314 - protein, 11 aa, Artificial Sequence
  Synthesized molecular recognition unit - light CDR3
CQQADTFPPTF

SEQ ID NO: 1315 - protein, 11 aa, Artificial Sequence [sequence omitted]

SEQ ID NO: 1316 - protein, 11 aa, Artificial Sequence [sequence omitted]

SEQ ID NO: 1317 - protein, 11 aa, Artificial Sequence [sequence omitted]

SEQ ID NO: 1318 - protein, 11 aa, Artificial Sequence [sequence omitted]

SEQ ID NO: 1319 - protein, 11 aa, Artificial Sequence [sequence omitted]

SEQ ID NO: 1320 - protein, 11 aa, Artificial Sequence [sequence omitted]

SEQ ID NO: 1321 - protein, 11 aa, Artificial Sequence [sequence omitted]

SEQ ID NO: 1322 - protein, 11 aa, Artificial Sequence
  Synthesized molecular recognition unit - light CDR3
CQQANTVPFTF

SEQ ID NO: 1323 - protein, 11 aa, Artificial Sequence
  Synthesized molecular recognition unit - light CDR3
CQQAYSFPQTF

SEQ ID NO: 1324 - protein, 11 aa, Artificial Sequence
  Synthesized molecular recognition unit - light CDR3
CQQAYSFPWTF

SEQ ID NO: 1325 - protein, 11 aa, Artificial Sequence
  Synthesized molecular recognition unit - light CDR3
CQQGFNFPLTF

SEQ ID NO: 1326 - protein, 11 aa, Artificial Sequence [sequence omitted]

SEQ ID NO: 1327 - protein, 11 aa, Artificial Sequence [sequence omitted]

SEQ ID NO: 1328 - protein, 11 aa, Artificial Sequence
  Synthesized molecular recognition unit - light CDR3
CQQGYNIPWTF

SEQ ID NO: 1329 - protein, 11 aa, Artificial Sequence
  Synthesized molecular recognition unit - light CDR3
CQQGYSAPWTF

SEQ ID NO: 1330 - protein, 11 aa, Artificial Sequence [sequence omitted]

SEQ ID NO: 1331 - protein, 11 aa, Artificial Sequence
  Synthesized molecular recognition unit - light CDR3
CQQLSRYPSLF

SEQ ID NO: 1332 - protein, 11 aa, Artificial Sequence
  Synthesized molecular recognition unit - light CDR3
CQQNDYLPLTF

SEQ ID NO: 1333 - protein, 11 aa, Artificial Sequence
  Synthesized molecular recognition unit - light CDR3
CQQNYATPRTF

SEQ ID NO: 1334 - protein, 11 aa, Artificial Sequence [sequence omitted]

SEQ ID NO: 1335 - protein, 11 aa, Artificial Sequence [sequence omitted]

SEQ ID NO: 1336 - protein, 13 aa, Artificial Sequence [sequence omitted]

SEQ ID NO: 1337 - protein, 13 aa, Artificial Sequence
  Synthesized molecular recognition unit - light CDR3
CQQRTNWPPRVTF

SEQ ID NO: 1338 - protein, 10 aa, Artificial Sequence
  Synthesized molecular recognition unit - light CDR3
CQQRYKSYTF

SEQ ID NO: 1339 - protein, 13 aa, Artificial Sequence
  Synthesized molecular recognition unit - light CDR3
CQQRYNWPPSITF

SEQ ID NO: 1340 - protein, 11 aa, Artificial Sequence [sequence omitted]

SEQ ID NO: 1341 - protein, 11 aa, Artificial Sequence
  Synthesized molecular recognition unit - light CDR3
CQQSFIMPLTF

SEQ ID NO: 1342 - protein, 11 aa, Artificial Sequence [sequence omitted]

SEQ ID NO: 1343 - protein, 10 aa, Artificial Sequence [sequence omitted]

SEQ ID NO: 1344 - protein, 11 aa, Artificial Sequence [sequence omitted]

SEQ ID NO: 1345 - protein, 11 aa, Artificial Sequence
  Synthesized molecular recognition unit - light CDR3
CQQSHSPPGTF

SEQ ID NO: 1346 - protein, 11 aa, Artificial Sequence [sequence omitted]

SEQ ID NO: 1347 - protein, 10 aa, Artificial Sequence
  Synthesized molecular recognition unit - light CDR3
CQQSSRFWTF

SEQ ID NO: 1348 - protein, 11 aa, Artificial Sequence [sequence omitted]

SEQ ID NO: 1349 - protein, 11 aa, Artificial Sequence [sequence omitted]

SEQ ID NO: 1350 - protein, 11 aa, Artificial Sequence [sequence omitted]

SEQ ID NO: 1351 - protein, 11 aa, Artificial Sequence [sequence omitted]

SEQ ID NO: 1352 - protein, 11 aa, Artificial Sequence [sequence omitted]

SEQ ID NO: 1353 - protein, 11 aa, Artificial Sequence [sequence omitted]

SEQ ID NO: 1354 - protein, 11 aa, Artificial Sequence [sequence omitted]

SEQ ID NO: 1355 - protein, 11 aa, Artificial Sequence [sequence omitted]

SEQ ID NO: 1356 - protein, 11 aa, Artificial Sequence [sequence omitted]

SEQ ID NO: 1357 - protein, 12 aa, Artificial Sequence
  Synthesized molecular recognition unit - light CDR3
CQQSYSHTAFTF

SEQ ID NO: 1358 - protein, 11 aa, Artificial Sequence [sequence omitted]

SEQ ID NO: 1359 - protein, 10 aa, Artificial Sequence [sequence omitted]

SEQ ID NO: 1360 - protein, 11 aa, Artificial Sequence [sequence omitted]

SEQ ID NO: 1361 - protein, 11 aa, Artificial Sequence [sequence omitted]

SEQ ID NO: 1362 - protein, 11 aa, Artificial Sequence [sequence omitted]

SEQ ID NO: 1363 - protein, 11 aa, Artificial Sequence [sequence omitted]

SEQ ID NO: 1364 - protein, 12 aa, Artificial Sequence [sequence omitted]

SEQ ID NO: 1365 - protein, 11 aa, Artificial Sequence [sequence omitted]

SEQ ID NO: 1366 - protein, 11 aa, Artificial Sequence [sequence omitted]

SEQ ID NO: 1367 - protein, 12 aa, Artificial Sequence [sequence omitted]

SEQ ID NO: 1368 - protein, 11 aa, Artificial Sequence [sequence omitted]

SEQ ID NO: 1369 - protein, 11 aa, Artificial Sequence [sequence omitted]

SEQ ID NO: 1370 - protein, 11 aa, Artificial Sequence [sequence omitted]

SEQ ID NO: 1371 - protein, 12 aa, Artificial Sequence [sequence omitted]

SEQ ID NO: 1372 - protein, 11 aa, Artificial Sequence [sequence omitted]

SEQ ID NO: 1373 - protein, 11 aa, Artificial Sequence
  Synthesized molecular recognition unit - light CDR3
CQQSYSTPRTF

SEQ ID NO: 1374 - protein, 12 aa, Artificial Sequence [sequence omitted]

SEQ ID NO: 1375 - protein, 10 aa, Artificial Sequence [sequence omitted]

SEQ ID NO: 1376 - protein, 10 aa, Artificial Sequence [sequence omitted]

SEQ ID NO: 1377 - protein, 11 aa, Artificial Sequence [sequence omitted]

SEQ ID NO: 1378 - protein, 11 aa, Artificial Sequence [sequence omitted]

SEQ ID NO: 1379 - protein, 11 aa, Artificial Sequence [sequence omitted]

SEQ ID NO: 1380 - protein, 11 aa, Artificial Sequence [sequence omitted]

SEQ ID NO: 1381 - protein, 13 aa, Artificial Sequence
  Synthesized molecular recognition unit - light CDR3
CQQSYTSTPLNSF

SEQ ID NO: 1382 - protein, 11 aa, Artificial Sequence [sequence omitted]

SEQ ID NO: 1383 - protein, 11 aa, Artificial Sequence
  Synthesized molecular recognition unit - light CDR3
CQQTFSPPLTF

SEQ ID NO: 1384 - protein, 11 aa, Artificial Sequence
  Synthesized molecular recognition unit - light CDR3
CQQTFSVPWTF

SEQ ID NO: 1385 - protein, 11 aa, Artificial Sequence
  Synthesized molecular recognition unit - light CDR3
CQQTNLFPYTF

SEQ ID NO: 1386 - protein, 11 aa, Artificial Sequence
  Synthesized molecular recognition unit - light CDR3
CQQTNTFPFTF

SEQ ID NO: 1387 - protein, 11 aa, Artificial Sequence [sequence omitted]

SEQ ID NO: 1388 - protein, 11 aa, Artificial Sequence
  Synthesized molecular recognition unit - light CDR3
CQQTYNIPITF

SEQ ID NO: 1389 - protein, 11 aa, Artificial Sequence
  Synthesized molecular recognition unit - light CDR3
CQQTYNPPRTF

SEQ ID NO: 1390 - protein, 11 aa, Artificial Sequence [sequence omitted]

SEQ ID NO: 1391 - protein, 11 aa, Artificial Sequence [sequence omitted]

SEQ ID NO: 1392 - protein, 11 aa, Artificial Sequence
  Synthesized molecular recognition unit - light CDR3
CQQTYSMPITF

SEQ ID NO: 1393 - protein, 11 aa, Artificial Sequence [sequence omitted]

SEQ ID NO: 1394 - protein, 11 aa, Artificial Sequence [sequence omitted]

SEQ ID NO: 1395 - protein, 11 aa, Artificial Sequence [sequence omitted]

SEQ ID NO: 1396 - protein, 11 aa, Artificial Sequence [sequence omitted]

SEQ ID NO: 1397 - protein, 11 aa, Artificial Sequence [sequence omitted]

SEQ ID NO: 1398 - protein, 10 aa, Artificial Sequence [sequence omitted]

SEQ ID NO: 1399 - protein, 11 aa, Artificial Sequence [sequence omitted]

SEQ ID NO: 1400 - protein, 10 aa, Artificial Sequence
  Synthesized molecular recognition unit - light CDR3
CQQYAISYTF

SEQ ID NO: 1401 - protein, 11 aa, Artificial Sequence [sequence omitted]

SEQ ID NO: 1402 - protein, 11 aa, Artificial Sequence
  Synthesized molecular recognition unit - light CDR3
CQQYDSWPPTF

SEQ ID NO: 1403 - protein, 11 aa, Artificial Sequence
  Synthesized molecular recognition unit - light CDR3
CQQYDTPLRTF

SEQ ID NO: 1404 - protein, 11 aa, Artificial Sequence [sequence omitted]

SEQ ID NO: 1405 - protein, 12 aa, Artificial Sequence
  Synthesized molecular recognition unit - light CDR3
CQQYETWPVLTF

SEQ ID NO: 1406 - protein, 11 aa, Artificial Sequence [sequence omitted]

SEQ ID NO: 1407 - protein, 10 aa, Artificial Sequence
  Synthesized molecular recognition unit - light CDR3
CQQYGIAPTF

SEQ ID NO: 1408 - protein, 11 aa, Artificial Sequence [sequence omitted]

SEQ ID NO: 1409 - protein, 12 aa, Artificial Sequence [sequence omitted]

SEQ ID NO: 1410 - protein, 11 aa, Artificial Sequence [sequence omitted]

SEQ ID NO: 1411 - protein, 10 aa, Artificial Sequence [sequence omitted]

SEQ ID NO: 1412 - protein, 11 aa, Artificial Sequence [sequence omitted]

SEQ ID NO: 1413 - protein, 11 aa, Artificial Sequence [sequence omitted]

SEQ ID NO: 1414 - protein, 11 aa, Artificial Sequence [sequence omitted]

SEQ ID NO: 1415 - protein, 10 aa, Artificial Sequence [sequence omitted]

SEQ ID NO: 1416 - protein, 11 aa, Artificial Sequence [sequence omitted]

SEQ ID NO: 1417 - protein, 13 aa, Artificial Sequence
  Synthesized molecular recognition unit - light CDR3
CQQYNHWPPLFTF

SEQ ID NO: 1418 - protein, 11 aa, Artificial Sequence [sequence omitted]

SEQ ID NO: 1419 - protein, 10 aa, Artificial Sequence
  Synthesized molecular recognition unit - light CDR3
CQQYNKSPSF

SEQ ID NO: 1420 - protein, 13 aa, Artificial Sequence [sequence omitted]

SEQ ID NO: 1421 - protein, 11 aa, Artificial Sequence [sequence omitted]

SEQ ID NO: 1422 - protein, 11 aa, Artificial Sequence [sequence omitted]

SEQ ID NO: 1423 - protein, 11 aa, Artificial Sequence [sequence omitted]

SEQ ID NO: 1424 - protein, 11 aa, Artificial Sequence [sequence omitted]

SEQ ID NO: 1425 - protein, 11 aa, Artificial Sequence
  Synthesized molecular recognition unit - light CDR3
CQQYSSYPYTI

SEQ ID NO: 1426 - protein, 11 aa, Artificial Sequence
  Synthesized molecular recognition unit - light CDR3
CQQYVSYPLTF

SEQ ID NO: 1427 - protein, 11 aa, Artificial Sequence
  Synthesized molecular recognition unit - light CDR3
CQQYYSYPWTS

SEQ ID NO: 1428 - protein, 11 aa, Artificial Sequence [sequence omitted]

SEQ ID NO: 1429 - protein, 13 aa, Artificial Sequence [sequence omitted]

SEQ ID NO: 1430 - protein, 12 aa, Artificial Sequence
  Synthesized molecular recognition unit - light CDR3
CQSYDYDHRWVF

SEQ ID NO: 1431 - protein, 11 aa, Artificial Sequence [sequence omitted]

SEQ ID NO: 1432 - protein, 13 aa, Artificial Sequence [sequence omitted]

SEQ ID NO: 1433 - protein, 11 aa, Artificial Sequence
  Synthesized molecular recognition unit - light CDR3
CTQTVQFPITF

SEQ ID NO: 1434 - protein, 11 aa, Artificial Sequence
  Synthesized molecular recognition unit - light CDR3
CVQTTQSPLTF

SEQ ID NO: 1435 - protein, 9 aa, Artificial Sequence
  Synthesized molecular recognition unit - light CDR3
SSFAGNSLE

SEQ ID NO: 1436 - protein, 9 aa, Artificial Sequence
  Synthesized molecular recognition unit - light CDR3
QSYANTLSL

SEQ ID NO: 1437 - protein, 9 aa, Artificial Sequence
  Synthesized molecular recognition unit - heavy CDR1
FSFSSHAMS

SEQ ID NO: 1438 - protein, 9 aa, Artificial Sequence
  Synthesized molecular recognition unit - heavy CDR1
FTFSDYYMS

SEQ ID NO: 1439 - protein, 10 aa, Artificial Sequence
  Synthesized molecular recognition unit - heavy CDR1
GYTFTNYDIN

SEQ ID NO: 1440 - protein, 9 aa, Artificial Sequence
  Synthesized molecular recognition unit - heavy CDR1
HTFTSHYMH

SEQ ID NO: 1441 - protein, 9 aa, Artificial Sequence
  Synthesized molecular recognition unit - heavy CDR1
YMFTGHDMH

SEQ ID NO: 1442 - protein, 9 aa, Artificial Sequence
  Synthesized molecular recognition unit - heavy CDR1
YSFTGYYLH

SEQ ID NO: 1443 - protein, 9 aa, Artificial Sequence
  Synthesized molecular recognition unit - heavy CDR1
YSFTNYYMH

SEQ ID NO: 1444 - protein, 9 aa, Artificial Sequence
  Synthesized molecular recognition unit - heavy CDR1
YTFAKYYIH

SEQ ID NO: 1445 - protein, 9 aa, Artificial Sequence
  Synthesized molecular recognition unit - heavy CDR1
YTFNGYYMH

SEQ ID NO: 1446 - protein, 9 aa, Artificial Sequence
  Synthesized molecular recognition unit - heavy CDR1
YTFSRHYIH

SEQ ID NO: 1447 - protein, 9 aa, Artificial Sequence
  Synthesized molecular recognition unit - heavy CDR1
YTFTDHYFH

SEQ ID NO: 1448 - protein, 9 aa, Artificial Sequence
  Synthesized molecular recognition unit - heavy CDR1
YTFTDSYIH

SEQ ID NO: 1449 - protein, 9 aa, Artificial Sequence
  Synthesized molecular recognition unit - heavy CDR1
YTFTDYYMH

SEQ ID NO: 1450 - protein, 9 aa, Artificial Sequence
  Synthesized molecular recognition unit - heavy CDR1
YTFTGYYIH

SEQ ID NO: 1451 - protein, 9 aa, Artificial Sequence
  Synthesized molecular recognition unit - heavy CDR1
YTFTNYYMH

SEQ ID NO: 1452 - protein, 9 aa, Artificial Sequence
  Synthesized molecular recognition unit - heavy CDR1
YTFTRYYIH

SEQ ID NO: 1453 - protein, 9 aa, Artificial Sequence
  Synthesized molecular recognition unit - heavy CDR1
YTFTRYYLH

SEQ ID NO: 1454 - protein, 9 aa, Artificial Sequence
  Synthesized molecular recognition unit - heavy CDR1
YTFTSSYIH

SEQ ID NO: 1455 - protein, 9 aa, Artificial Sequence
  Synthesized molecular recognition unit - heavy CDR1
YWFTASYMH

SEQ ID NO: 1456 - protein, 9 aa, Artificial Sequence
  Synthesized molecular recognition unit - heavy CDR1
GTFSSYAIT

SEQ ID NO: 1457 - protein, 9 aa, Artificial Sequence
  Synthesized molecular recognition unit - heavy CDR1
GTFSSYGIS

SEQ ID NO: 1458 - protein, 13 aa, Artificial Sequence
  Synthesized molecular recognition unit - heavy CDR2
GDIIPIFGSANYA

SEQ ID NO: 1459 - protein, 13 aa, Artificial Sequence
  Synthesized molecular recognition unit - heavy CDR2
GIINPSGGGAVYA

SEQ ID NO: 1460 - protein, 13 aa, Artificial Sequence
  Synthesized molecular recognition unit - heavy CDR2
GIVNPSGGGTNYA

SEQ ID NO: 1461 - protein, 13 aa, Artificial Sequence
  Synthesized molecular recognition unit - heavy CDR2
GRINPHNGNTNYA

SEQ ID NO: 1462 - protein, 13 aa, Artificial Sequence
  Synthesized molecular recognition unit - heavy CDR2
GWANPSSGNTGTA

SEQ ID NO: 1463 - protein, 13 aa, Artificial Sequence
  Synthesized molecular recognition unit - heavy CDR2
GWINPNSGNTGYA

SEQ ID NO: 1464 - protein, 13 aa, Artificial Sequence
  Synthesized molecular recognition unit - heavy CDR2
GWMDPNSGYTGYA

SEQ ID NO: 1465 - protein, 13 aa, Artificial Sequence
  Synthesized molecular recognition unit - heavy CDR2
GWMKPDSGNTGYA

SEQ ID NO: 1466 - protein, 13 aa, Artificial Sequence
  Synthesized molecular recognition unit - heavy CDR2
GWMNPNSANAGYA

SEQ ID NO: 1467 - protein, 13 aa, Artificial Sequence
  Synthesized molecular recognition unit - heavy CDR2
GWMNPNSGSTGYA

SEQ ID NO: 1468 - protein, 13 aa, Artificial Sequence
  Synthesized molecular recognition unit - heavy CDR2
SAISGSGHSTYYA

SEQ ID NO: 1469 - protein, 17 aa, Artificial Sequence
  Synthesized molecular recognition unit - heavy CDR2
WIYPRDGSTKYNEKFKG

SEQ ID NO: 1470 - protein, 8 aa, Artificial Sequence
  Synthesized molecular recognition unit - heavy CDR3
CANPKHYW

SEQ ID NO: 1471 - protein, 19 aa, Artificial Sequence
  Synthesized molecular recognition unit - heavy CDR3
CARANRGLRKNYYYGMDVW

SEQ ID NO: 1472 - protein, 18 aa, Artificial Sequence
  Synthesized molecular recognition unit - heavy CDR3
CARATRVSAAGTVHFQHW

SEQ ID NO: 1473 - protein, 24 aa, Artificial Sequence
  Synthesized molecular recognition unit - heavy CDR3
CARDHGTMIAVAGTFDYYYYMDVW

SEQ ID NO: 1474 - protein, 16 aa, Artificial Sequence
  Synthesized molecular recognition unit - heavy CDR3
CAREDDFWSGGGMDVW

SEQ ID NO: 1475 - protein, 15 aa, Artificial Sequence
  Synthesized molecular recognition unit - heavy CDR3
CAREGLRGWSIFDIW

SEQ ID NO: 1476 - protein, 13 aa, Artificial Sequence
  Synthesized molecular recognition unit - heavy CDR3
CARELGLGWFDPW

SEQ ID NO: 1477 - protein, 14 aa, Artificial Sequence
  Synthesized molecular recognition unit - heavy CDR3
CARGDINYGNFDYW

SEQ ID NO: 1478 - protein, 24 aa, Artificial Sequence
  Synthesized molecular recognition unit - heavy CDR3
CARGDIVATMGMKKVDYYYYMDVW

SEQ ID NO: 1479 - protein, 17 aa, Artificial Sequence
  Synthesized molecular recognition unit - heavy CDR3
CARGGHTGYSSGWYNHW

SEQ ID NO: 1480 - protein, 19 aa, Artificial Sequence
  Synthesized molecular recognition unit - heavy CDR3
CARGGNYGRWLQPWYFDLW

SEQ ID NO: 1481 - protein, 8 aa, Artificial Sequence [sequence omitted]

SEQ ID NO: 1482 - protein, 19 aa, Artificial Sequence
  Synthesized molecular recognition unit - heavy CDR3
CARGIHGDYGLDYYYMDVW

SEQ ID NO: 1483 - protein, 11 aa, Artificial Sequence [sequence omitted]

SEQ ID NO: 1484 - protein, 8 aa, Artificial Sequence
  Synthesized molecular recognition unit - heavy CDR3
CARGMEYW

SEQ ID NO: 1485 - protein, 20 aa, Artificial Sequence
  Synthesized molecular recognition unit - heavy CDR3
CARGPADFWSGYKNDYFDFW

SEQ ID NO: 1486 - protein, 11 aa, Artificial Sequence [sequence omitted]

SEQ ID NO: 1487 - protein, 15 aa, Artificial Sequence
  Synthesized molecular recognition unit - heavy CDR3
CARHKRHTPYAFDIW

SEQ ID NO: 1488 - protein, 15 aa, Artificial Sequence
  Synthesized molecular recognition unit - heavy CDR3
CARQGGSYSMGLDPW

SEQ ID NO: 1489 - protein, 15 aa, Artificial Sequence
  Synthesized molecular recognition unit - heavy CDR3
CARRSSSWGWYFDLW

SEQ ID NO: 1490 - protein, 17 aa, Artificial Sequence
  Synthesized molecular recognition unit - heavy CDR3
CARSPDFWSGEGYFDLW

SEQ ID NO: 1491 - protein, 15 aa, Artificial Sequence
  Synthesized molecular recognition unit - heavy CDR3
CARSRLRWDWYFDLW

SEQ ID NO: 1492 - protein, 15 aa, Artificial Sequence
  Synthesized molecular recognition unit - heavy CDR3
CARSYYGVIDAFDIW

SEQ ID NO: 1493 - protein, 17 aa, Artificial Sequence
  Synthesized molecular recognition unit - heavy CDR3
CARVGDYDRFNWYFDLW

SEQ ID NO: 1494 - protein, 13 aa, Artificial Sequence
  Synthesized molecular recognition unit - heavy CDR3
CARVRFLEEMDVW

SEQ ID NO: 1495 - protein, 16 aa, Artificial Sequence
  Synthesized molecular recognition unit - heavy CDR3
CARWTTVVTGAAFDIW

SEQ ID NO: 1496 - protein, 10 aa, Artificial Sequence
  Synthesized molecular recognition unit - heavy CDR3
CVRSAWGFAY

SEQ ID NO: 1497 - protein, 11 aa, Artificial Sequence
  Synthesized molecular recognition unit - light CDR1
KASQDVGTAVA

SEQ ID NO: 1498 - protein, 17 aa, Artificial Sequence
  Synthesized molecular recognition unit - light CDR1
KSSQSVLHSSNNKNYLA

SEQ ID NO: 1499 - protein, 11 aa, Artificial Sequence
  Synthesized molecular recognition unit - light CDR1
RASQAIGRRLA

SEQ ID NO: 1500 - protein, 11 aa, Artificial Sequence
  Synthesized molecular recognition unit - light CDR1
RASQDISNNLN

SEQ ID NO: 1501 - protein, 11 aa, Artificial Sequence
  Synthesized molecular recognition unit - light CDR1
RASQDISRGLG

SEQ ID NO: 1502 - protein, 11 aa, Artificial Sequence
  Synthesized molecular recognition unit - light CDR1
RASQGIRNDLN

SEQ ID NO: 1503 - protein, 11 aa, Artificial Sequence
  Synthesized molecular recognition unit - light CDR1
RASQGISKYLA

SEQ ID NO: 1504 - protein, 11 aa, Artificial Sequence
  Synthesized molecular recognition unit - light CDR1
RASQGISSWLA

SEQ ID NO: 1505 - protein, 11 aa, Artificial Sequence
  Synthesized molecular recognition unit - light CDR1
RASQGVSTYLA

SEQ ID NO: 1506 - protein, 11 aa, Artificial Sequence
  Synthesized molecular recognition unit - light CDR1
RASQNINSWLA

SEQ ID NO: 1507 - protein, 11 aa, Artificial Sequence
  Synthesized molecular recognition unit - light CDR1
RASQSIARYLN

SEQ ID NO: 1508 - protein, 11 aa, Artificial Sequence
  Synthesized molecular recognition unit - light CDR1
RASQSIGNYLN

SEQ ID NO: 1509 - protein, 11 aa, Artificial Sequence
  Synthesized molecular recognition unit - light CDR1
RASQSIISYLN

SEQ ID NO: 1510 - protein, 11 aa, Artificial Sequence
  Synthesized molecular recognition unit - light CDR1
RASQSISKWLA

SEQ ID NO: 1511 - protein, 11 aa, Artificial Sequence
  Synthesized molecular recognition unit - light CDR1
RASQSITTYLN

SEQ ID NO: 1512 - protein, 11 aa, Artificial Sequence
  Synthesized molecular recognition unit - light CDR1
RASQSLSSWLA

SEQ ID NO: 1513 - protein, 11 aa, Artificial Sequence
  Synthesized molecular recognition unit - light CDR1
RASQTISSYLN

SEQ ID NO: 1514 - protein, 11 aa, Artificial Sequence
  Synthesized molecular recognition unit - light CDR1
RASRTVYNFLA

SEQ ID NO: 1515 - protein, 7 aa, Artificial Sequence
  Synthesized molecular recognition unit - light CDR2
AASRLQT

SEQ ID NO: 1516 - protein, 7 aa, Artificial Sequence
  Synthesized molecular recognition unit - light CDR2
AASSLQT

SEQ ID NO: 1517 - protein, 7 aa, Artificial Sequence
  Synthesized molecular recognition unit - light CDR2
AASTLYR

SEQ ID NO: 1518 - protein, 7 aa, Artificial Sequence
  Synthesized molecular recognition unit - light CDR2
DASNLGT

SEQ ID NO: 1519 - protein, 7 aa, Artificial Sequence
  Synthesized molecular recognition unit - light CDR2
DASNLRT

SEQ ID NO: 1520 - protein, 7 aa, Artificial Sequence
  Synthesized molecular recognition unit - light CDR2
DASTLQS

SEQ ID NO: 1521 - protein, 7 aa, Artificial Sequence
  Synthesized molecular recognition unit - light CDR2
GASALRS

SEQ ID NO: 1522 - protein, 7 aa, Artificial Sequence
  Synthesized molecular recognition unit - light CDR2
GASHLQT

SEQ ID NO: 1523 - protein, 7 aa, Artificial Sequence
  Synthesized molecular recognition unit - light CDR2
KASTLHN

SEQ ID NO: 1524 - protein, 7 aa, Artificial Sequence
  Synthesized molecular recognition unit - light CDR2
KTSSLQS

SEQ ID NO: 1525 - protein, 7 aa, Artificial Sequence
  Synthesized molecular recognition unit - light CDR2
LGSSRAS

SEQ ID NO: 1526 - protein, 7 aa, Artificial Sequence
  Synthesized molecular recognition unit - light CDR2
WASTRES

SEQ ID NO: 1527 - protein, 7 aa, Artificial Sequence
  Synthesized molecular recognition unit - light CDR2
WASTRHT

SEQ ID NO: 1528 - protein, 11 aa, Artificial Sequence [sequence omitted]

SEQ ID NO: 1529 - protein, 11 aa, Artificial Sequence
  Synthesized molecular recognition unit - light CDR3
CQQAFRFPPTF

SEQ ID NO: 1530 - protein, 11 aa, Artificial Sequence [sequence omitted]

SEQ ID NO: 1531 - protein, 11 aa, Artificial Sequence [sequence omitted]

SEQ ID NO: 1532 - protein, 11 aa, Artificial Sequence
  Synthesized molecular recognition unit - light CDR3
CQQSFRLPLTF

SEQ ID NO: 1533 - protein, 11 aa, Artificial Sequence [sequence omitted]

SEQ ID NO: 1534 - protein, 11 aa, Artificial Sequence
  Synthesized molecular recognition unit - light CDR3
CQQSSRIPPTF

SEQ ID NO: 1535 - protein, 11 aa, Artificial Sequence
  Synthesized molecular recognition unit - light CDR3
CQQSWRFPYTF

SEQ ID NO: 1536 - protein, 11 aa, Artificial Sequence [sequence omitted]

SEQ ID NO: 1537 - protein, 11 aa, Artificial Sequence
  Synthesized molecular recognition unit - light CDR3
CQQSYSTPPTF

SEQ ID NO: 1538 - protein, 11 aa, Artificial Sequence [sequence omitted]

SEQ ID NO: 1539 - protein, 11 aa, Artificial Sequence [sequence omitted]

SEQ ID NO: 1540 - protein, 11 aa, Artificial Sequence [sequence omitted]

SEQ ID NO: 1541 - protein, 10 aa, Artificial Sequence [sequence omitted]

SEQ ID NO: 1542 - protein, 11 aa, Artificial Sequence [sequence omitted]

SEQ ID NO: 1543 - protein, 11 aa, Artificial Sequence [sequence omitted]

SEQ ID NO: 1544 - protein, 11 aa, Artificial Sequence [sequence omitted]

SEQ ID NO: 1545 - protein, 11 aa, Artificial Sequence [sequence omitted]

SEQ ID NO: 1546 - protein, 9 aa, Artificial Sequence
  Synthesized molecular recognition unit - light CDR3
QQYSTYPLT

SEQ ID NO: 1547 - protein, 9 aa, Artificial Sequence
  Synthesized molecular recognition unit - heavy CDR1
DTFANYGFS

SEQ ID NO: 1548 - protein, 9 aa, Artificial Sequence
  Synthesized molecular recognition unit - heavy CDR1
FAFKDYYMT

SEQ ID NO: 1549 - protein, 9 aa, Artificial Sequence
  Synthesized molecular recognition unit - heavy CDR1
FAFSTTAMS

SEQ ID NO: 1550 - protein, 9 aa, Artificial Sequence
  Synthesized molecular recognition unit - heavy CDR1
FALSGYYMS

SEQ ID NO: 1551 - protein, 9 aa, Artificial Sequence
  Synthesized molecular recognition unit - heavy CDR1
FPFRYYGMS

SEQ ID NO: 1552 - protein, 9 aa, Artificial Sequence
  Synthesized molecular recognition unit - heavy CDR1
FPFZYYSMN

SEQ ID NO: 1553 - protein, 9 aa, Artificial Sequence
  Synthesized molecular recognition unit - heavy CDR1
FRFSISTMG

SEQ ID NO: 1554 - protein, 9 aa, Artificial Sequence
  Synthesized molecular recognition unit - heavy CDR1
FSFDDYGMS

SEQ ID NO: 1555 - protein, 9 aa, Artificial Sequence
  Synthesized molecular recognition unit - heavy CDR1
FSFETYGMS

SEQ ID NO: 1556 - protein, 9 aa, Artificial Sequence
  Synthesized molecular recognition unit - heavy CDR1
FSFNTFGIH

SEQ ID NO: 1557 - protein, 9 aa, Artificial Sequence
  Synthesized molecular recognition unit - heavy CDR1
FSFNTYAMN

SEQ ID NO: 1558 - protein, 9 aa, Artificial Sequence
  Synthesized molecular recognition unit - heavy CDR1
FSFSDYYMS

SEQ ID NO: 1559 - protein, 9 aa, Artificial Sequence
  Synthesized molecular recognition unit - heavy CDR1
FSFSSYSMN

SEQ ID NO: 1560 - protein, 9 aa, Artificial Sequence
  Synthesized molecular recognition unit - heavy CDR1
FTFDAYAMH

SEQ ID NO: 1561 - protein, 9 aa, Artificial Sequence
  Synthesized molecular recognition unit - heavy CDR1
FTFDDYGMS

SEQ ID NO: 1562 - protein, 9 aa, Artificial Sequence
  Synthesized molecular recognition unit - heavy CDR1
FTFDEYAMH

SEQ ID NO: 1563 - protein, 9 aa, Artificial Sequence
  Synthesized molecular recognition unit - heavy CDR1
FTFNSYSMD

SEQ ID NO: 1564 - protein, 9 aa, Artificial Sequence
  Synthesized molecular recognition unit - heavy CDR1
FTFRNYAIH

SEQ ID NO: 1565 - protein, 9 aa, Artificial Sequence
  Synthesized molecular recognition unit - heavy CDR1
FTFSAHGMH

SEQ ID NO: 1566 - protein, 9 aa, Artificial Sequence
  Synthesized molecular recognition unit - heavy CDR1
FTFSDFAMT

SEQ ID NO: 1567 - protein, 9 aa, Artificial Sequence
  Synthesized molecular recognition unit - heavy CDR1
FTFSDHYMS

SEQ ID NO: 1568 - protein, 9 aa, Artificial Sequence
  Synthesized molecular recognition unit - heavy CDR1
FTFSDYYMS

SEQ ID NO: 1569 - protein, 9 aa, Artificial Sequence
  Synthesized molecular recognition unit - heavy CDR1
FTFSKTDMH

SEQ ID NO: 1570 - protein, 9 aa, Artificial Sequence
  Synthesized molecular recognition unit - heavy CDR1
FTFSNSDMN

SEQ ID NO: 1571 - protein, 9 aa, Artificial Sequence
  Synthesized molecular recognition unit - heavy CDR1
FTFSNYWIH

SEQ ID NO: 1572 - protein, 9 aa, Artificial Sequence
  Synthesized molecular recognition unit - heavy CDR1
FTFSRHSMN

SEQ ID NO: 1573 - protein, 9 aa, Artificial Sequence
  Synthesized molecular recognition unit - heavy CDR1
FTFSSHSTH

SEQ ID NO: 1574 - protein, 9 aa, Artificial Sequence
  Synthesized molecular recognition unit - heavy CDR1
FTFSSSAMH

SEQ ID NO: 1575 - protein, 9 aa, Artificial Sequence
  Synthesized molecular recognition unit - heavy CDR1
FTFSSSWMH

SEQ ID NO: 1576 - protein, 9 aa, Artificial Sequence
  Synthesized molecular recognition unit - heavy CDR1
FTFSSYAMH

SEQ ID NO: 1577 - protein, 9 aa, Artificial Sequence
  Synthesized molecular recognition unit - heavy CDR1
FTFSSYAMS

SEQ ID NO: 1578 - protein, 9 aa, Artificial Sequence
  Synthesized molecular recognition unit - heavy CDR1
FTFSSYDMH

SEQ ID NO: 1579 - protein, 9 aa, Artificial Sequence
  Synthesized molecular recognition unit - heavy CDR1
FTFSSYSMN

SEQ ID NO: 1580 - protein, 9 aa, Artificial Sequence
  Synthesized molecular recognition unit - heavy CDR1
FTFSSYWMH

SEQ ID NO: 1581 - protein, 9 aa, Artificial Sequence
  Synthesized molecular recognition unit - heavy CDR1
FTFSSZZMH

SEQ ID NO: 1582 - protein, 9 aa, Artificial Sequence
  Synthesized molecular recognition unit - heavy CDR1
FTFSTFGMH

SEQ ID NO: 1583 - protein, 9 aa, Artificial Sequence
  Synthesized molecular recognition unit - heavy CDR1
FTFSTHAFH

SEQ ID NO: 1584 - protein, 9 aa, Artificial Sequence
  Synthesized molecular recognition unit - heavy CDR1
FTFSTYGMH

SEQ ID NO: 1585 - protein, 9 aa, Artificial Sequence
  Synthesized molecular recognition unit - heavy CDR1
FTFSTYSMN

SEQ ID NO: 1586 - protein, 9 aa, Artificial Sequence
  Synthesized molecular recognition unit - heavy CDR1
FTFSTYYMS

SEQ ID NO: 1587 - protein, 9 aa, Artificial Sequence
  Synthesized molecular recognition unit - heavy CDR1
FTFTDYGLH

SEQ ID NO: 1588 - protein, 9 aa, Artificial Sequence
  Synthesized molecular recognition unit - heavy CDR1
FTFTSSAMQ

SEQ ID NO: 1589 - protein, 9 aa, Artificial Sequence
  Synthesized molecular recognition unit - heavy CDR1
FTFTSSAVQ

SEQ ID NO: 1590 - protein, 9 aa, Artificial Sequence
  Synthesized molecular recognition unit - heavy CDR1
FTFZNAWMS

SEQ ID NO: 1591 - protein, 9 aa, Artificial Sequence
  Synthesized molecular recognition unit - heavy CDR1
FTLRNHWLS

SEQ ID NO: 1592 - protein, 9 aa, Artificial Sequence
  Synthesized molecular recognition unit - heavy CDR1
FTVSSNYMS

SEQ ID NO: 1593 - protein, 9 aa, Artificial Sequence
  Synthesized molecular recognition unit - heavy CDR1
GDLSIYTIN

SEQ ID NO: 1594 - protein, 9 aa, Artificial Sequence
  Synthesized molecular recognition unit - heavy CDR1
GSFSDYYWS

SEQ ID NO: 1595 - protein, 9 aa, Artificial Sequence
  Synthesized molecular recognition unit - heavy CDR1
GSFSGYYWT

SEQ ID NO: 1596 - protein, 9 aa, Artificial Sequence
  Synthesized molecular recognition unit - heavy CDR1
GSLSGYYWS

SEQ ID NO: 1597 - protein, 9 aa, Artificial Sequence
  Synthesized molecular recognition unit - heavy CDR1
GTFHTYGLS

SEQ ID NO: 1598 - protein, 9 aa, Artificial Sequence
  Synthesized molecular recognition unit - heavy CDR1
GTFNSNAIS

SEQ ID NO: 1599 - protein, 9 aa, Artificial Sequence
  Synthesized molecular recognition unit - heavy CDR1
GTFNTHTIT

SEQ ID NO: 1600 - protein, 9 aa, Artificial Sequence
  Synthesized molecular recognition unit - heavy CDR1
GTFSHYTIS

SEQ ID NO: 1601 - protein, 9 aa, Artificial Sequence
  Synthesized molecular recognition unit - heavy CDR1
GTFSRYHMG

SEQ ID NO: 1602 - protein, 9 aa, Artificial Sequence
  Synthesized molecular recognition unit - heavy CDR1
GTFSSHAIN

SEQ ID NO: 1603 - protein, 9 aa, Artificial Sequence
  Synthesized molecular recognition unit - heavy CDR1
GTFSSYAIS

SEQ ID NO: 1604 - protein, 9 aa, Artificial Sequence
  Synthesized molecular recognition unit - heavy CDR1
GTFSZYAIS

SEQ ID NO: 1605 - protein, 9 aa, Artificial Sequence
  Synthesized molecular recognition unit - heavy CDR1
GTISDYTVS

SEQ ID NO: 1606 - protein, 9 aa, Artificial Sequence
  Synthesized molecular recognition unit - heavy CDR1
HTFLTYDIN

SEQ ID NO: 1607 - protein, 9 aa, Artificial Sequence
  Synthesized molecular recognition unit - heavy CDR1
HTFSSYAMG

SEQ ID NO: 1608 - protein, 9 aa, Artificial Sequence
  Synthesized molecular recognition unit - heavy CDR1
IAFRYYDMG

SEQ ID NO: 1609 - protein, 8 aa, Artificial Sequence
  Synthesized molecular recognition unit - heavy CDR1
ISSVYGMG

SEQ ID NO: 1610 - protein, 9 aa, Artificial Sequence
  Synthesized molecular recognition unit - heavy CDR1
LPFSRYAMA

SEQ ID NO: 1611 - protein, 9 aa, Artificial Sequence
  Synthesized molecular recognition unit - heavy CDR1
LSFSSYAMG

SEQ ID NO: 1612 - protein, 13 aa, Artificial Sequence
  Synthesized molecular recognition unit - heavy CDR1
LSSGRPFSSYVMG

SEQ ID NO: 1613 - protein, 9 aa, Artificial Sequence
  Synthesized molecular recognition unit - heavy CDR1
LTFDDHAMH

SEQ ID NO: 1614 - protein, 9 aa, Artificial Sequence
  Synthesized molecular recognition unit - heavy CDR1
LTFSNAAMA

SEQ ID NO: 1615 - protein, 9 aa, Artificial Sequence
  Synthesized molecular recognition unit - heavy CDR1
LTFTSHGMS

SEQ ID NO: 1616 - protein, 9 aa, Artificial Sequence
  Synthesized molecular recognition unit - heavy CDR1
NIFPIDDMS

SEQ ID NO: 1617 - protein, 9 aa, Artificial Sequence
  Synthesized molecular recognition unit - heavy CDR1
NINSIETLG

SEQ ID NO: 1618 - protein, 9 aa, Artificial Sequence
  Synthesized molecular recognition unit - heavy CDR1
RIFAIYDIA

SEQ ID NO: 1619 - protein, 9 aa, Artificial Sequence
  Synthesized molecular recognition unit - heavy CDR1
RIFAIYDMA

SEQ ID NO: 1620 - protein, 9 aa, Artificial Sequence
  Synthesized molecular recognition unit - heavy CDR1
RIFSIYDIA

SEQ ID NO: 1621 - protein, 9 aa, Artificial Sequence
  Synthesized molecular recognition unit - heavy CDR1
RIFSIYDMG

SEQ ID NO: 1622 - protein, 9 aa, Artificial Sequence
  Synthesized molecular recognition unit - heavy CDR1
RLLSYYALA

SEQ ID NO: 1623 - protein, 9 aa, Artificial Sequence
  Synthesized molecular recognition unit - heavy CDR1
RRFTTYGMG

SEQ ID NO: 1624 - protein, 9 aa, Artificial Sequence
  Synthesized molecular recognition unit - heavy CDR1
RSFNSYTTT

SEQ ID NO: 1625 - protein, 9 aa, Artificial Sequence
  Synthesized molecular recognition unit - heavy CDR1
RSFNSYVIG

SEQ ID NO: 1626 - protein, 9 aa, Artificial Sequence
  Synthesized molecular recognition unit - heavy CDR1
RSFSDFFMG

SEQ ID NO: 1627 - protein, 9 aa, Artificial Sequence
  Synthesized molecular recognition unit - heavy CDR1
RSLSSFAMG

SEQ ID NO: 1628 - protein, 9 aa, Artificial Sequence
  Synthesized molecular recognition unit - heavy CDR1
RSVSIYPMG

SEQ ID NO: 1629 - protein, 9 aa, Artificial Sequence
  Synthesized molecular recognition unit - heavy CDR1
RSVSSYNMG

SEQ ID NO: 1630 - protein, 9 aa, Artificial Sequence
  Synthesized molecular recognition unit - heavy CDR1
RTFGNYDMG

SEQ ID NO: 1631 - protein, 9 aa, Artificial Sequence
  Synthesized molecular recognition unit - heavy CDR1
RTFGSDVMG

SEQ ID NO: 1632 - protein, 9 aa, Artificial Sequence
  Synthesized molecular recognition unit - heavy CDR1
RTFGTYPNG

SEQ ID NO: 1633 - protein, 9 aa, Artificial Sequence
  Synthesized molecular recognition unit - heavy CDR1
RTFNIDDMG

SEQ ID NO: 1634 - protein, 9 aa, Artificial Sequence
  Synthesized molecular recognition unit - heavy CDR1
RTFNSGTMG

SEQ ID NO: 1635 - protein, 9 aa, Artificial Sequence
  Synthesized molecular recognition unit - heavy CDR1
RTFNTYAMG

SEQ ID NO: 1636 - protein, 9 aa, Artificial Sequence
  Synthesized molecular recognition unit - heavy CDR1
RTFRRYAMG

SEQ ID NO: 1637 - protein, 9 aa, Artificial Sequence
  Synthesized molecular recognition unit - heavy CDR1
RTFRSYTMG

SEQ ID NO: 1638 - protein, 9 aa, Artificial Sequence
  Synthesized molecular recognition unit - heavy CDR1
RTFSDYSMA

SEQ ID NO: 1639 - protein, 9 aa, Artificial Sequence
  Synthesized molecular recognition unit - heavy CDR1
RTFSDYSMG

SEQ ID NO: 1640 - protein, 9 aa, Artificial Sequence
  Synthesized molecular recognition unit - heavy CDR1
RTFSMYDMG

SEQ ID NO: 1641 - protein, 9 aa, Artificial Sequence
  Synthesized molecular recognition unit - heavy CDR1
RTFSNYAVG

SEQ ID NO: 1642 - protein, 9 aa, Artificial Sequence
  Synthesized molecular recognition unit - heavy CDR1
RTFSRYAMA

SEQ ID NO: 1643 - protein, 9 aa, Artificial Sequence
  Synthesized molecular recognition unit - heavy CDR1
RTFSRYAMG

SEQ ID NO: 1644 - protein, 9 aa, Artificial Sequence
  Synthesized molecular recognition unit - heavy CDR1
RTFSRYVMG

SEQ ID NO: 1645 - protein, 9 aa, Artificial Sequence
  Synthesized molecular recognition unit - heavy CDR1
RTFSSYAMA

SEQ ID NO: 1646 - protein, 9 aa, Artificial Sequence
  Synthesized molecular recognition unit - heavy CDR1
RTFSSYAMS

SEQ ID NO: 1647 - protein, 9 aa, Artificial Sequence
  Synthesized molecular recognition unit - heavy CDR1
RTFSSYAVG

SEQ ID NO: 1648 - protein, 9 aa, Artificial Sequence
  Synthesized molecular recognition unit - heavy CDR1
RTFSVYGVG

SEQ ID NO: 1649 - protein, 9 aa, Artificial Sequence
  Synthesized molecular recognition unit - heavy CDR1
RTFSYYAMG

SEQ ID NO: 1650 - protein, 9 aa, Artificial Sequence
  Synthesized molecular recognition unit - heavy CDR1
RTLSAYDMG

SEQ ID NO: 1651 - protein, 9 aa, Artificial Sequence
  Synthesized molecular recognition unit - heavy CDR1
RTLSRYSMG

SEQ ID NO: 1652 - protein, 9 aa, Artificial Sequence
  Synthesized molecular recognition unit - heavy CDR1
RTLSSFAMG

SEQ ID NO: 1653 - protein, 9 aa, Artificial Sequence
  Synthesized molecular recognition unit - heavy CDR1
RVLSYYAMA

SEQ ID NO: 1654 - protein, 9 aa, Artificial Sequence
  Synthesized molecular recognition unit - heavy CDR1
SIFMINTMA

SEQ ID NO: 1655 - protein, 9 aa, Artificial Sequence
  Synthesized molecular recognition unit - heavy CDR1
SIFRLGTMY

SEQ ID NO: 1656 - protein, 9 aa, Artificial Sequence
  Synthesized molecular recognition unit - heavy CDR1
SIFSDGAMG

SEQ ID NO: 1657 - protein, 9 aa, Artificial Sequence
  Synthesized molecular recognition unit - heavy CDR1
SIFSINTMG

SEQ ID NO: 1658 - protein, 9 aa, Artificial Sequence
  Synthesized molecular recognition unit - heavy CDR1
SIFSIYAMG

SEQ ID NO: 1659 - protein, 9 aa, Artificial Sequence
  Synthesized molecular recognition unit - heavy CDR1
SISSFNTMG

SEQ ID NO: 1660 - protein, 9 aa, Artificial Sequence
  Synthesized molecular recognition unit - heavy CDR1
SIVRSLPMA

SEQ ID NO: 1661 - protein, 9 aa, Artificial Sequence
  Synthesized molecular recognition unit - heavy CDR1
SLFSFNAMG

SEQ ID NO: 1662 - protein, 9 aa, Artificial Sequence
  Synthesized molecular recognition unit - heavy CDR1
SLFSFNAVG

SEQ ID NO: 1663 - protein, 9 aa, Artificial Sequence
  Synthesized molecular recognition unit - heavy CDR1
SVFTTFAKG

SEQ ID NO: 1664 - protein, 9 aa, Artificial Sequence
  Synthesized molecular recognition unit - heavy CDR1
TIFSINTMG

SEQ ID NO: 1665 - protein, 9 aa, Artificial Sequence
  Synthesized molecular recognition unit - heavy CDR1
TIVSIYRIN

SEQ ID NO: 1666 - protein, 9 aa, Artificial Sequence
  Synthesized molecular recognition unit - heavy CDR1
VIFALYDIA

SEQ ID NO: 1667 - protein, 9 aa, Artificial Sequence
  Synthesized molecular recognition unit - heavy CDR1
VTFSRYPIS

SEQ ID NO: 1668 - protein, 9 aa, Artificial Sequence
  Synthesized molecular recognition unit - heavy CDR1
YGFTGYYIH

SEQ ID NO: 1669 - protein, 9 aa, Artificial Sequence
  Synthesized molecular recognition unit - heavy CDR1
YIFTDYYMH

SEQ ID NO: 1670 - protein, 9 aa, Artificial Sequence
  Synthesized molecular recognition unit - heavy CDR1
YSFTRTDMH

SEQ ID NO: 1671 - protein, 9 aa, Artificial Sequence
  Synthesized molecular recognition unit - heavy CDR1
YTFASYDIH

SEQ ID NO: 1672 - protein, 9 aa, Artificial Sequence
  Synthesized molecular recognition unit - heavy CDR1
YTFSYRYLH

SEQ ID NO: 1673 - protein, 9 aa, Artificial Sequence
  Synthesized molecular recognition unit - heavy CDR1
YTFTDYFMN

SEQ ID NO: 1674 - protein, 9 aa, Artificial Sequence
  Synthesized molecular recognition unit - heavy CDR1
YTFTGYYIH

SEQ ID NO: 1675 - protein, 9 aa, Artificial Sequence
  Synthesized molecular recognition unit - heavy CDR1
YTFTGYYMH

SEQ ID NO: 1676 - protein, 9 aa, Artificial Sequence
  Synthesized molecular recognition unit - heavy CDR1
YTFTNNFMH

SEQ ID NO: 1677 - protein, 9 aa, Artificial Sequence
  Synthesized molecular recognition unit - heavy CDR1
YTFTNYCMH

SEQ ID NO: 1678 - protein, 9 aa, Artificial Sequence
  Synthesized molecular recognition unit - heavy CDR1
YTFTSYAMN

SEQ ID NO: 1679 - protein, 9 aa, Artificial Sequence
  Synthesized molecular recognition unit - heavy CDR1
YTFTSYDIN

SEQ ID NO: 1680 - protein, 9 aa, Artificial Sequence
  Synthesized molecular recognition unit - heavy CDR1
YTFTSYYMH

SEQ ID NO: 1681 - protein, 9 aa, Artificial Sequence
  Synthesized molecular recognition unit - heavy CDR1
YTFTYRYLH

SEQ ID NO: 1682 - protein, 9 aa, Artificial Sequence
  Synthesized molecular recognition unit - heavy CDR1
YTISNYYIH

SEQ ID NO: 1683 - protein, 9 aa, Artificial Sequence
  Synthesized molecular recognition unit - heavy CDR1
YZFTDYYMH

SEQ ID NO: 1684 - protein, 13 aa, Artificial Sequence
  Synthesized molecular recognition unit - heavy CDR2
AAIKWSGTNTYYA

SEQ ID NO: 1685 - protein, 13 aa, Artificial Sequence
  Synthesized molecular recognition unit - heavy CDR2
AAINWSGDSTKYA

SEQ ID NO: 1686 - protein, 13 aa, Artificial Sequence
  Synthesized molecular recognition unit - heavy CDR2
AAIQWSADNTFYA

SEQ ID NO: 1687 - protein, 13 aa, Artificial Sequence
  Synthesized molecular recognition unit - heavy CDR2
AAIRGSSGSTFYA

SEQ ID NO: 1688 - protein, 13 aa, Artificial Sequence
  Synthesized molecular recognition unit - heavy CDR2
AAIRWSGDNTYYA

SEQ ID NO: 1689 - protein, 13 aa, Artificial Sequence
  Synthesized molecular recognition unit - heavy CDR2
AAIRWSGGGTYYA

SEQ ID NO: 1690 - protein, 13 aa, Artificial Sequence
  Synthesized molecular recognition unit - heavy CDR2
AAISGSGGSTTYA

SEQ ID NO: 1691 - protein, 13 aa, Artificial Sequence
  Synthesized molecular recognition unit - heavy CDR2
AAISQSGYVRYYA

SEQ ID NO: 1692 - protein, 13 aa, Artificial Sequence
  Synthesized molecular recognition unit - heavy CDR2
AAISRFGGSTYYA

SEQ ID NO: 1693 - protein, 13 aa, Artificial Sequence
  Synthesized molecular recognition unit - heavy CDR2
AAISRFGGSTYYV

SEQ ID NO: 1694 - protein, 13 aa, Artificial Sequence
  Synthesized molecular recognition unit - heavy CDR2
AAISRNGDKSHYS

SEQ ID NO: 1695 - protein, 13 aa, Artificial Sequence
  Synthesized molecular recognition unit - heavy CDR2
AAISRRGGIIEYG

SEQ ID NO: 1696 - protein, 13 aa, Artificial Sequence
  Synthesized molecular recognition unit - heavy CDR2
AAISRSGANTAYS

SEQ ID NO: 1697 - protein, 13 aa, Artificial Sequence
  Synthesized molecular recognition unit - heavy CDR2
AAISRSGDRIYYS

SEQ ID NO: 1698 - protein, 12 aa, Artificial Sequence
  Synthesized molecular recognition unit - heavy CDR2
AAISRSGGIYYA

SEQ ID NO: 1699 - protein, 13 aa, Artificial Sequence
  Synthesized molecular recognition unit - heavy CDR2
AAISRSGVSTYYA

SEQ ID NO: 1700 - protein, 12 aa, Artificial Sequence
  Synthesized molecular recognition unit - heavy CDR2
AAISWGGRTAYA

SEQ ID NO: 1701 - protein, 13 aa, Artificial Sequence
  Synthesized molecular recognition unit - heavy CDR2
AAISWSGGSTKYA

SEQ ID NO: 1702 - protein, 13 aa, Artificial Sequence
  Synthesized molecular recognition unit - heavy CDR2
AAISYSGGSTKYA

SEQ ID NO: 1703 - protein, 13 aa, Artificial Sequence
  Synthesized molecular recognition unit - heavy CDR2
AAITRSGSNTYYA

SEQ ID NO: 1704 - protein, 13 aa, Artificial Sequence
  Synthesized molecular recognition unit - heavy CDR2
AAITWNGRSSDYA

SEQ ID NO: 1705 - protein, 13 aa, Artificial Sequence
  Synthesized molecular recognition unit - heavy CDR2
AAITWRGGITYYA

SEQ ID NO: 1706 - protein, 13 aa, Artificial Sequence
  Synthesized molecular recognition unit - heavy CDR2
AAITWRGGSTYYA

SEQ ID NO: 1707 - protein, 13 aa, Artificial Sequence
  Synthesized molecular recognition unit - heavy CDR2
AAVSASGGYTWYA

SEQ ID NO: 1708 - protein, 13 aa, Artificial Sequence
  Synthesized molecular recognition unit - heavy CDR2
AAVTWRSGSTYYA

SEQ ID NO: 1709 - protein, 12 aa, Artificial Sequence
  Synthesized molecular recognition unit - heavy CDR2
AGIRWSGSTLYA

SEQ ID NO: 1710 - protein, 13 aa, Artificial Sequence
  Synthesized molecular recognition unit - heavy CDR2
AGISWIADNRYYA

SEQ ID NO: 1711 - protein, 13 aa, Artificial Sequence
  Synthesized molecular recognition unit - heavy CDR2
AGITRGGATTYYS

SEQ ID NO: 1712 - protein, 12 aa, Artificial Sequence
  Synthesized molecular recognition unit - heavy CDR2
AGITSSGRTIYA

SEQ ID NO: 1713 - protein, 13 aa, Artificial Sequence
  Synthesized molecular recognition unit - heavy CDR2
AGMSGEGRNTKYR

SEQ ID NO: 1714 - protein, 14 aa, Artificial Sequence
  Synthesized molecular recognition unit - heavy CDR2
ALTGWGDGSTTYYE

SEQ ID NO: 1715 - protein, 13 aa, Artificial Sequence
  Synthesized molecular recognition unit - heavy CDR2
AMIRPVVTEIDYA

SEQ ID NO: 1716 - protein, 12 aa, Artificial Sequence
  Synthesized molecular recognition unit - heavy CDR2
ANMRGGGYMKYA

SEQ ID NO: 1717 - protein, 13 aa, Artificial Sequence
  Synthesized molecular recognition unit - heavy CDR2
ARIGWNGGSIVYA

SEQ ID NO: 1718 - protein, 13 aa, Artificial Sequence
  Synthesized molecular recognition unit - heavy CDR2
ARISRGDGYTDEA

SEQ ID NO: 1719 - protein, 12 aa, Artificial Sequence
  Synthesized molecular recognition unit - heavy CDR2
ASIGKSGSTNYA

SEQ ID NO: 1720 - protein, 13 aa, Artificial Sequence
  Synthesized molecular recognition unit - heavy CDR2
ASIRWSGQSPYYA

SEQ ID NO: 1721 - protein, 13 aa, Artificial Sequence
  Synthesized molecular recognition unit - heavy CDR2
ASIRWSSGNTWYA

SEQ ID NO: 1722 - protein, 12 aa, Artificial Sequence
  Synthesized molecular recognition unit - heavy CDR2
ASISSGGRTNYA

SEQ ID NO: 1723 - protein, 12 aa, Artificial Sequence
  Synthesized molecular recognition unit - heavy CDR2
ASISSGSRTNYA

SEQ ID NO: 1724 - protein, 13 aa, Artificial Sequence
  Synthesized molecular recognition unit - heavy CDR2
ASISSTSGSKYYA

SEQ ID NO: 1725 - protein, 13 aa, Artificial Sequence
  Synthesized molecular recognition unit - heavy CDR2
ASITASSDRTFYA

SEQ ID NO: 1726 - protein, 13 aa, Artificial Sequence
  Synthesized molecular recognition unit - heavy CDR2
ASVSWRYDRTYYT

SEQ ID NO: 1727 - protein, 11 aa, Artificial Sequence
  Synthesized molecular recognition unit - heavy CDR2
ATINDAQRYYA

SEQ ID NO: 1728 - protein, 13 aa, Artificial Sequence
  Synthesized molecular recognition unit - heavy CDR2
ATIRPVVSETTYA

SEQ ID NO: 1729 - protein, 13 aa, Artificial Sequence
  Synthesized molecular recognition unit - heavy CDR2
ATIRPVVTETDYA

SEQ ID NO: 1730 - protein, 13 aa, Artificial Sequence
  Synthesized molecular recognition unit - heavy CDR2
ATIRPVVTQIDYA

SEQ ID NO: 1731 - protein, 13 aa, Artificial Sequence
  Synthesized molecular recognition unit - heavy CDR2
ATISASGGNTAYA

SEQ ID NO: 1732 - protein, 13 aa, Artificial Sequence
  Synthesized molecular recognition unit - heavy CDR2
ATISRSGGNTYYA

SEQ ID NO: 1733 - protein, 13 aa, Artificial Sequence
  Synthesized molecular recognition unit - heavy CDR2
ATISWSGSSANYE

SEQ ID NO: 1734 - protein, 12 aa, Artificial Sequence
  Synthesized molecular recognition unit - heavy CDR2
ATMTSGGNTNYA

SEQ ID NO: 1735 - protein, 12 aa, Artificial Sequence
  Synthesized molecular recognition unit - heavy CDR2
ATVTSGGRINYA

SEQ ID NO: 1736 - protein, 13 aa, Artificial Sequence
  Synthesized molecular recognition unit - heavy CDR2
AVIGRSGGIKYYA

SEQ ID NO: 1737 - protein, 11 aa, Artificial Sequence
  Synthesized molecular recognition unit - heavy CDR2
AVISGGRTGYA

SEQ ID NO: 1738 - protein, 13 aa, Artificial Sequence
  Synthesized molecular recognition unit - heavy CDR2
AVISYDGSNKYYA

SEQ ID NO: 1739 - protein, 13 aa, Artificial Sequence
  Synthesized molecular recognition unit - heavy CDR2
AVISYGGSNKYYA

SEQ ID NO: 1740 - protein, 12 aa, Artificial Sequence
  Synthesized molecular recognition unit - heavy CDR2
AVITSGGKTVYA

SEQ ID NO: 1741 - protein, 12 aa, Artificial Sequence
  Synthesized molecular recognition unit - heavy CDR2
AVITTGGDTSYS

SEQ ID NO: 1742 - protein, 13 aa, Artificial Sequence
  Synthesized molecular recognition unit - heavy CDR2
AVTSYDGGKKNYA

SEQ ID NO: 1743 - protein, 12 aa, Artificial Sequence
  Synthesized molecular recognition unit - heavy CDR2
AYITGGGRTMDG

SEQ ID NO: 1744 - protein, 13 aa, Artificial Sequence
  Synthesized molecular recognition unit - heavy CDR2
GAISRSGNNTYYA

SEQ ID NO: 1745 - protein, 12 aa, Artificial Sequence
  Synthesized molecular recognition unit - heavy CDR2
GEINHSGATNYN

SEQ ID NO: 1746 - protein, 12 aa, Artificial Sequence
  Synthesized molecular recognition unit - heavy CDR2
GEINHSGSTNYN

SEQ ID NO: 1747 - protein, 13 aa, Artificial Sequence
  Synthesized molecular recognition unit - heavy CDR2
GGFDPEDGETIYA

SEQ ID NO: 1748 - protein, 13 aa, Artificial Sequence
  Synthesized molecular recognition unit - heavy CDR2
GGIIPIFGTADYA

SEQ ID NO: 1749 - protein, 13 aa, Artificial Sequence
  Synthesized molecular recognition unit - heavy CDR2
GGIIPIFGTANYA

SEQ ID NO: 1750 - protein, 13 aa, Artificial Sequence
  Synthesized molecular recognition unit - heavy CDR2
GGIIPLFGTANYA

SEQ ID NO: 1751 - protein, 13 aa, Artificial Sequence
  Synthesized molecular recognition unit - heavy CDR2
GGIIPVFGTADYA

SEQ ID NO: 1752 - protein, 13 aa, Artificial Sequence
  Synthesized molecular recognition unit - heavy CDR2
GGIIPVFGTANYA

SEQ ID NO: 1753 - protein, 13 aa, Artificial Sequence
  Synthesized molecular recognition unit - heavy CDR2
GGIRWSGGTTLYP

SEQ ID NO: 1754 - protein, 13 aa, Artificial Sequence
  Synthesized molecular recognition unit - heavy CDR2
GGIVPAYRRANYA

SEQ ID NO: 1755 - protein, 13 aa, Artificial Sequence
  Synthesized molecular recognition unit - heavy CDR2
GGVIPIFGTADYA

SEQ ID NO: 1756 - protein, 13 aa, Artificial Sequence
  Synthesized molecular recognition unit - heavy CDR2
GHVDPGDGETIYA

SEQ ID NO: 1757 - protein, 13 aa, Artificial Sequence
  Synthesized molecular recognition unit - heavy CDR2
GIINPSDGSTSHA

SEQ ID NO: 1758 - protein, 13 aa, Artificial Sequence
  Synthesized molecular recognition unit - heavy CDR2
GIINPSGDSTRFA

SEQ ID NO: 1759 - protein, 13 aa, Artificial Sequence
  Synthesized molecular recognition unit - heavy CDR2
GIINPSGGSTIYA

SEQ ID NO: 1760 - protein, 13 aa, Artificial Sequence
  Synthesized molecular recognition unit - heavy CDR2
GIINPSGGSTNYA

SEQ ID NO: 1761 - protein, 13 aa, Artificial Sequence
  Synthesized molecular recognition unit - heavy CDR2
GIINPSGGSTSYA

SEQ ID NO: 1762 - protein, 13 aa, Artificial Sequence
  Synthesized molecular recognition unit - heavy CDR2
GMINPSGGSTTYA

SEQ ID NO: 1763 - protein, 13 aa, Artificial Sequence
  Synthesized molecular recognition unit - heavy CDR2
GRIIPIFGTANYA

SEQ ID NO: 1764 - protein, 13 aa, Artificial Sequence
  Synthesized molecular recognition unit - heavy CDR2
GRIIPIHGIANYA

SEQ ID NO: 1765 - protein, 13 aa, Artificial Sequence
  Synthesized molecular recognition unit - heavy CDR2
GRIIPILGRANYA

SEQ ID NO: 1766 - protein, 13 aa, Artificial Sequence
  Synthesized molecular recognition unit - heavy CDR2
GRIIPILGRTNYA

SEQ ID NO: 1767 - protein, 13 aa, Artificial Sequence
  Synthesized molecular recognition unit - heavy CDR2
GRIIPILGSTNYA

SEQ ID NO: 1768 - protein, 13 aa, Artificial Sequence
  Synthesized molecular recognition unit - heavy CDR2
GRIIPVLKITNYA

SEQ ID NO: 1769 - protein, 13 aa, Artificial Sequence
  Synthesized molecular recognition unit - heavy CDR2
GRINPNGGGTIYA

SEQ ID NO: 1770 - protein, 13 aa, Artificial Sequence
  Synthesized molecular recognition unit - heavy CDR2
GRITPRLGIANYA

SEQ ID NO: 1771 - protein, 13 aa, Artificial Sequence
  Synthesized molecular recognition unit - heavy CDR2
GWINAGNGNTKYS

SEQ ID NO: 1772 - protein, 13 aa, Artificial Sequence
  Synthesized molecular recognition unit - heavy CDR2
GWINAGNGNTTYA

SEQ ID NO: 1773 - protein, 13 aa, Artificial Sequence
  Synthesized molecular recognition unit - heavy CDR2
GWINPNSGDTNYA

SEQ ID NO: 1774 - protein, 13 aa, Artificial Sequence
  Synthesized molecular recognition unit - heavy CDR2
GWINPNSGGTNYA

SEQ ID NO: 1775 - protein, 13 aa, Artificial Sequence
  Synthesized molecular recognition unit - heavy CDR2
GWISANNGNTDYA

SEQ ID NO: 1776 - protein, 13 aa, Artificial Sequence
  Synthesized molecular recognition unit - heavy CDR2
GWMNPNSGNTGYA

SEQ ID NO: 1777 - protein, 13 aa, Artificial Sequence
  Synthesized molecular recognition unit - heavy CDR2
  misc_feature (2)..(2): Xaa can be any naturally occurring amino acid
GXVNAGNGNTTYA

SEQ ID NO: 1778 - protein, 13 aa, Artificial Sequence
  Synthesized molecular recognition unit - heavy CDR2
GYISAYTGHTSYA

SEQ ID NO: 1779 - protein, 12 aa, Artificial Sequence
  Synthesized molecular recognition unit - heavy CDR2
SAIGAGGGTYYA

SEQ ID NO: 1780 - protein, 12 aa, Artificial Sequence
  Synthesized molecular recognition unit - heavy CDR2
SAIGTGGDTYYA

SEQ ID NO: 1781 - protein, 12 aa, Artificial Sequence
  Synthesized molecular recognition unit - heavy CDR2
SAIGTGGGTYYA

SEQ ID NO: 1782 - protein, 12 aa, Artificial Sequence
  Synthesized molecular recognition unit - heavy CDR2
SAIGTGGGTZYA

SEQ ID NO: 1783 - protein, 12 aa, Artificial Sequence
  Synthesized molecular recognition unit - heavy CDR2
SAIGTGGSTYYA

SEQ ID NO: 1784 - protein, 13 aa, Artificial Sequence
  Synthesized molecular recognition unit - heavy CDR2
SAIRGSGERTYYA

SEQ ID NO: 1785 - protein, 13 aa, Artificial Sequence
  Synthesized molecular recognition unit - heavy CDR2
SAISGRDGRTYYA

SEQ ID NO: 1786 - protein, 13 aa, Artificial Sequence
  Synthesized molecular recognition unit - heavy CDR2
SAISGSGGSTYYA

SEQ ID NO: 1787 - protein, 13 aa, Artificial Sequence
  Synthesized molecular recognition unit - heavy CDR2
SAISSGSDRTYYA

SEQ ID NO: 1788 - protein, 13 aa, Artificial Sequence
  Synthesized molecular recognition unit - heavy CDR2
SAITWSGGRTYYA

SEQ ID NO: 1789 - protein, 12 aa, Artificial Sequence
  Synthesized molecular recognition unit - heavy CDR2
SGIRWSGGTSYA

SEQ ID NO: 1790 - protein, 13 aa, Artificial Sequence
  Synthesized molecular recognition unit - heavy CDR2
SGISESGGRTYYA

SEQ ID NO: 1791 - protein, 13 aa, Artificial Sequence
  Synthesized molecular recognition unit - heavy CDR2
SGISESGGSTYYA

SEQ ID NO: 1792 - protein, 13 aa, Artificial Sequence
  Synthesized molecular recognition unit - heavy CDR2
SGISGSGGRTHYA

SEQ ID NO: 1793 - protein, 13 aa, Artificial Sequence
  Synthesized molecular recognition unit - heavy CDR2
SGISGSGGSTYYA

SEQ ID NO: 1794 - protein, 13 aa, Artificial Sequence
  Synthesized molecular recognition unit - heavy CDR2
SGISWNGGKTHYV

SEQ ID NO: 1795 - protein, 13 aa, Artificial Sequence
  Synthesized molecular recognition unit - heavy CDR2
SGISWNSGRIGYA

SEQ ID NO: 1796 - protein, 13 aa, Artificial Sequence
  Synthesized molecular recognition unit - heavy CDR2
SGISWNSGSIGYA

SEQ ID NO: 1797 - protein, 13 aa, Artificial Sequence
  Synthesized molecular recognition unit - heavy CDR2
SGISWNSGTTGYS

SEQ ID NO: 1798 - protein, 13 aa, Artificial Sequence
  Synthesized molecular recognition unit - heavy CDR2
SGITSNGGATYYA

SEQ ID NO: 1799 - protein, 13 aa, Artificial Sequence
  Synthesized molecular recognition unit - heavy CDR2
SGVSWNGSRTHYA

SEQ ID NO: 1800 - protein, 13 aa, Artificial Sequence
  Synthesized molecular recognition unit - heavy CDR2
SMISYNGGRAFYA

SEQ ID NO: 1801 - protein, 13 aa, Artificial Sequence
  Synthesized molecular recognition unit - heavy CDR2
SSISGSGGVTYYA

SEQ ID NO: 1802 - protein, 13 aa, Artificial Sequence
  Synthesized molecular recognition unit - heavy CDR2
SSISPRGGSTYYA

SEQ ID NO: 1803 - protein, 13 aa, Artificial Sequence
  Synthesized molecular recognition unit - heavy CDR2
SSISSSSTYIRYA

SEQ ID NO: 1804 - protein, 13 aa, Artificial Sequence
  Synthesized molecular recognition unit - heavy CDR2
SSISVSSGTTHYA

SEQ ID NO: 1805 - protein, 13 aa, Artificial Sequence
  Synthesized molecular recognition unit - heavy CDR2
SSISVSSGTTHYA

SEQ ID NO: 1806 - protein, 13 aa, Artificial Sequence
  Synthesized molecular recognition unit - heavy CDR2
STINPGGLSKSYA

SEQ ID NO: 1807 - protein, 13 aa, Artificial Sequence
  Synthesized molecular recognition unit - heavy CDR2
STISDTNSGTYYA

SEQ ID NO: 1808 - protein, 13 aa, Artificial Sequence
  Synthesized molecular recognition unit - heavy CDR2
STISGSGGRTYYA

SEQ ID NO: 1809 - protein, 13 aa, Artificial Sequence
  Synthesized molecular recognition unit - heavy CDR2
STISGSGGSTYYA

SEQ ID NO: 1810 - protein, 13 aa, Artificial Sequence
  Synthesized molecular recognition unit - heavy CDR2
STITTDSRGTYYA

SEQ ID NO: 1811 - protein, 13 aa, Artificial Sequence
  Synthesized molecular recognition unit - heavy CDR2
STLSGDANNAYYA

SEQ ID NO: 1812 - protein, 12 aa, Artificial Sequence
  Synthesized molecular recognition unit - heavy CDR2
SVISSGGTIYYA

SEQ ID NO: 1813 - protein, 13 aa, Artificial Sequence
  Synthesized molecular recognition unit - heavy CDR2
SYISGDSGYTNYA

SEQ ID NO: 1814 - protein, 13 aa, Artificial Sequence
  Synthesized molecular recognition unit - heavy CDR2
SYISGNSGYTNYA

SEQ ID NO: 1815 - protein, 13 aa, Artificial Sequence
  Synthesized molecular recognition unit - heavy CDR2
SYISSSGRTIFYA

SEQ ID NO: 1816 - protein, 13 aa, Artificial Sequence
  Synthesized molecular recognition unit - heavy CDR2
SYISSSSSTIYYA

SEQ ID NO: 1817 - protein, 13 aa, Artificial Sequence
  Synthesized molecular recognition unit - heavy CDR2
SYSSGNSGYTNYA

SEQ ID NO: 1818 - protein, 13 aa, Artificial Sequence
  Synthesized molecular recognition unit - heavy CDR2
SYVSDSGSSVYYA

SEQ ID NO: 1819 - protein, 13 aa, Artificial Sequence
  Synthesized molecular recognition unit - heavy CDR2
ZHVDPEDGETIYA

SEQ ID NO: 1820 - protein, 24 aa, Artificial Sequence
  Synthesized molecular recognition unit - heavy CDR3
CAAARRSGTYDIGQYLRESAYVFW

SEQ ID NO: 1821 - protein, 17 aa, Artificial Sequence
  Synthesized molecular recognition unit - heavy CDR3
CAAAYSYSQYGSSYSYW

SEQ ID NO: 1822 - protein, 13 aa, Artificial Sequence
  Synthesized molecular recognition unit - heavy CDR3
CAADDLGLELHYW

SEQ ID NO: 1823 - protein, 19 aa, Artificial Sequence
  Synthesized molecular recognition unit - heavy CDR3
CAADPRGVTLPRATAYEYW

SEQ ID NO: 1824 - protein, 22 aa, Artificial Sequence
  Synthesized molecular recognition unit - heavy CDR3
CAADRIENYLGRYYDPSEYEYW

SEQ ID NO: 1825 - protein, 22 aa, Artificial Sequence
  Synthesized molecular recognition unit - heavy CDR3
CAADRIENYLGRYYDPSEYEYW

SEQ ID NO: 1826 - protein, 21 aa, Artificial Sequence
  Synthesized molecular recognition unit - heavy CDR3
CAADTNWRAGPRVGIDEYAYW

SEQ ID NO: 1827 - protein, 17 aa, Artificial Sequence
  Synthesized molecular recognition unit - heavy CDR3
CAAGPNWSTRNREYDYW

SEQ ID NO: 1828 - protein, 14 aa, Artificial Sequence
  Synthesized molecular recognition unit - heavy CDR3
CAAGSTVVAEFNYW

SEQ ID NO: 1829 - protein, 14 aa, Artificial Sequence
  Synthesized molecular recognition unit - heavy CDR3
CAAGSTVVAEFNYW

SEQ ID NO: 1830 - protein, 14 aa, Artificial Sequence
  Synthesized molecular recognition unit - heavy CDR3
CAAGSTVVAEFNYW

SEQ ID NO: 1831 - protein, 18 aa, Artificial Sequence
  Synthesized molecular recognition unit - heavy CDR3
CAAKFGVLATTESRHDYW

SEQ ID NO: 1832 - protein, 20 aa, Artificial Sequence
  Synthesized molecular recognition unit - heavy CDR3
CAAQFRNDYGLRYQSTNNYW

SEQ ID NO: 1833 - protein, 21 aa, Artificial Sequence
  Synthesized molecular recognition unit - heavy CDR3
CAARTSGGLFHYRRSDHWDTW

SEQ ID NO: 1834 - protein, 22 aa, Artificial Sequence
  Synthesized molecular recognition unit - heavy CDR3
CAASMEAMNSLRVNKERYYQSW

SEQ ID NO: 1835 - protein, 22 aa, Artificial Sequence
  Synthesized molecular recognition unit - heavy CDR3
CAASMEAMNSLRVNKERYYQSW

SEQ ID NO: 1836 - protein, 22 aa, Artificial Sequence
  Synthesized molecular recognition unit - heavy CDR3
CAASMEAMNSLRVNKERYYQSW

SEQ ID NO: 1837 - protein, 17 aa, Artificial Sequence
  Synthesized molecular recognition unit - heavy CDR3
CAASVYISRRDSDYGYW

SEQ ID NO: 1838 - protein, 21 aa, Artificial Sequence
  Synthesized molecular recognition unit - heavy CDR3
CAAVFTGRFYGRPPREKYDYW

SEQ ID NO: 1839 - protein, 19 aa, Artificial Sequence
  Synthesized molecular recognition unit - heavy CDR3
CAAVQAVIGGTLTTAYDYW

SEQ ID NO: 1840 - protein, 19 aa, Artificial Sequence
  Synthesized molecular recognition unit - heavy CDR3
CAAYSTFNTDVASMKPDYW

SEQ ID NO: 1841 - protein, 21 aa, Artificial Sequence
  Synthesized molecular recognition unit - heavy CDR3
CAGDRSRYLYGDSLRGPYGYW

SEQ ID NO: 1842 - protein, 14 aa, Artificial Sequence
  Synthesized molecular recognition unit - heavy CDR3
CAIVRGKKWYFDLW

SEQ ID NO: 1843 - protein, 18 aa, Artificial Sequence
  Synthesized molecular recognition unit - heavy CDR3
CAKAQATGWSGYYTFDYW

SEQ ID NO: 1844 - protein, 18 aa, Artificial Sequence
  Synthesized molecular recognition unit - heavy CDR3
CAKAQATGWSGYYTFDYW

SEQ ID NO: 1845 - protein, 14 aa, Artificial Sequence
  Synthesized molecular recognition unit - heavy CDR3
CAKDDFSLYGMDVW

SEQ ID NO: 1846 - protein, 13 aa, Artificial Sequence
  Synthesized molecular recognition unit - heavy CDR3
CAKDGTDGRFDPW

SEQ ID NO: 1847 - protein, 17 aa, Artificial Sequence
  Synthesized molecular recognition unit - heavy CDR3
CAKDLGIQLPDYYFDYW

SEQ ID NO: 1848 - protein, 16 aa, Artificial Sequence
  Synthesized molecular recognition unit - heavy CDR3
CAKDLGRAAAGSMDVW

SEQ ID NO: 1849 - protein, 16 aa, Artificial Sequence
  Synthesized molecular recognition unit - heavy CDR3
CAKDLGRAAAGSMDVW

SEQ ID NO: 1850 - protein, 16 aa, Artificial Sequence
  Synthesized molecular recognition unit - heavy CDR3
CAKDLGRAAAGSMDVW

SEQ ID NO: 1851 - protein, 17 aa, Artificial Sequence
  Synthesized molecular recognition unit - heavy CDR3
CAKDMVHLIVALAIDYW

SEQ ID NO: 1852 - protein, 8 aa, Artificial Sequence
  Synthesized molecular recognition unit - heavy CDR3
CAKDSGLV

SEQ ID NO: 1853 - protein, 8 aa, Artificial Sequence
  Synthesized molecular recognition unit - heavy CDR3
CAKDSGLV

SEQ ID NO: 1854 - protein, 16 aa, Artificial Sequence
  Synthesized molecular recognition unit - heavy CDR3
CAKDSGNYGYYGMDVW

SEQ ID NO: 1855 - protein, 19 aa, Artificial Sequence
  Synthesized molecular recognition unit - heavy CDR3
CAKEDYDSSGYYYYYFQHW

SEQ ID NO: 1856 - protein, 17 aa, Artificial Sequence
  Synthesized molecular recognition unit - heavy CDR3
CAKGGDYFYYYYGMDVW

SEQ ID NO: 1857 - protein, 17 aa, Artificial Sequence
  Synthesized molecular recognition unit - heavy CDR3
CAKGGDYFYYYYGMDVW

SEQ ID NO: 1858 - protein, 17 aa, Artificial Sequence
  Synthesized molecular recognition unit - heavy CDR3
CAKGGDYYYYYYGMDVW

SEQ ID NO: 1859 - protein, 16 aa, Artificial Sequence
  Synthesized molecular recognition unit - heavy CDR3
CAKGGRDGYKGYFDYW

SEQ ID NO: 1860 - protein, 16 aa, Artificial Sequence
  Synthesized molecular recognition unit - heavy CDR3
CAKGGRDGYKGYFDYW

SEQ ID NO: 1861 - protein, 16 aa, Artificial Sequence
  Synthesized molecular recognition unit - heavy CDR3
CAKGGRDGYKGYFDYW

SEQ ID NO: 1862 - protein, 16 aa, Artificial Sequence
  Synthesized molecular recognition unit - heavy CDR3
CAKGGRDGYKGYFDYW

SEQ ID NO: 1863 - protein, 16 aa, Artificial Sequence
  Synthesized molecular recognition unit - heavy CDR3
CAKGGRDGYKGYFDYW

SEQ ID NO: 1864 - protein, 12 aa, Artificial Sequence
  Synthesized molecular recognition unit - heavy CDR3
CAKGGSLDMDVW

SEQ ID NO: 1865 - protein, 11 aa, Artificial Sequence
  Synthesized molecular recognition unit - heavy CDR3
CAKGGYELDYW

SEQ ID NO: 1866 - protein, 11 aa, Artificial Sequence
  Synthesized molecular recognition unit - heavy CDR3
CAKGWLDFDYW

SEQ ID NO: 1867 - protein, 11 aa, Artificial Sequence
  Synthesized molecular recognition unit - heavy CDR3
CAKGWLDFDYW

SEQ ID NO: 1868 - protein, 18 aa, Artificial Sequence
  Synthesized molecular recognition unit - heavy CDR3
CAKSIAAAGTGYYGMDVW

SEQ ID NO: 1869 - protein, 18 aa, Artificial Sequence
  Synthesized molecular recognition unit - heavy CDR3
CAKSIAAAGTGYYGMDVW

SEQ ID NO: 1870 - protein, 18 aa, Artificial Sequence
  Synthesized molecular recognition unit - heavy CDR3
CAKTYYDFWSGYYTFDYW

SEQ ID NO: 1871 - protein, 15 aa, Artificial Sequence
  Synthesized molecular recognition unit - heavy CDR3
CAKVASGWSWPFDIW

SEQ ID NO: 1872 - protein, 19 aa, Artificial Sequence
  Synthesized molecular recognition unit - heavy CDR3
CALTWAPTPTNRRSDYAYW

SEQ ID NO: 1873 - protein, 14 aa, Artificial Sequence
  Synthesized molecular recognition unit - heavy CDR3
CANGLEDAYAFDIW

SEQ ID NO: 1874 - protein, 14 aa, Artificial Sequence
  Synthesized molecular recognition unit - heavy CDR3
CAPALTDAGSFDYW

SEQ ID NO: 1875 - protein, 20 aa, Artificial Sequence
  Synthesized molecular recognition unit - heavy CDR3
CAPYYYDKSAKPLRSYFDHW

SEQ ID NO: 1876 - protein, 18 aa, Artificial Sequence
  Synthesized molecular recognition unit - heavy CDR3
CARAAGNFWSGYYTFDYW

SEQ ID NO: 1877 - protein, 18 aa, Artificial Sequence
  Synthesized molecular recognition unit - heavy CDR3
CARAAGNFWSGYYTFDYW

SEQ ID NO: 1878 - protein, 21 aa, Artificial Sequence
  Synthesized molecular recognition unit - heavy CDR3
CARAGIAAAPGSRNYYGMDVW

SEQ ID NO: 1879 - protein, 16 aa, Artificial Sequence
  Synthesized molecular recognition unit - heavy CDR3
CARAGTNWGGWYFDLW

SEQ ID NO: 1880 - protein, 16 aa, Artificial Sequence
  Synthesized molecular recognition unit - heavy CDR3
CARAGYGRYYYGMDVW

SEQ ID NO: 1881 - protein, 18 aa, Artificial Sequence
  Synthesized molecular recognition unit - heavy CDR3
CARAGYWSGYGYYGMDVW

SEQ ID NO: 1882 - protein, 18 aa, Artificial Sequence
  Synthesized molecular recognition unit - heavy CDR3
CARAGYYDSSGYYAFDIW

SEQ ID NO: 1883 - protein, 16 aa, Artificial Sequence
  Synthesized molecular recognition unit - heavy CDR3
CARATGSGWYTDLGYW

SEQ ID NO: 1884 - protein, 16 aa, Artificial Sequence
  Synthesized molecular recognition unit - heavy CDR3
CARATGSGWYTDLGYW

SEQ ID NO: 1885 - protein, 12 aa, Artificial Sequence
  Synthesized molecular recognition unit - heavy CDR3
CARDAGGDYDYW

SEQ ID NO: 1886 - protein, 18 aa, Artificial Sequence
  Synthesized molecular recognition unit - heavy CDR3
CARDASGGSTGWYYFDSW

SEQ ID NO: 1887 - protein, 18 aa, Artificial Sequence
  Synthesized molecular recognition unit - heavy CDR3
CARDASGGSTGWYYFDSW

SEQ ID NO: 1888 - protein, 13 aa, Artificial Sequence
  Synthesized molecular recognition unit - heavy CDR3
CARDDGLGGMDVW

SEQ ID NO: 1889 - protein, 13 aa, Artificial Sequence
  Synthesized molecular recognition unit - heavy CDR3
CARDDGLGGMDVW

SEQ ID NO: 1890 - protein, 13 aa, Artificial Sequence
  Synthesized molecular recognition unit - heavy CDR3
CARDDSMGAFDIW

SEQ ID NO: 1891 - protein, 13 aa, Artificial Sequence
  Synthesized molecular recognition unit - heavy CDR3
CARDEVEGGMDVW

SEQ ID NO: 1892 - protein, 13 aa, Artificial Sequence
  Synthesized molecular recognition unit - heavy CDR3
CARDFLGSTGDYW

SEQ ID NO: 1893 - protein, 13 aa, Artificial Sequence
  Synthesized molecular recognition unit - heavy CDR3
CARDFLGSTGDYW

SEQ ID NO: 1894 - protein, 13 aa, Artificial Sequence
  Synthesized molecular recognition unit - heavy CDR3
CARDGGIRDFDYW

SEQ ID NO: 1895 - protein, 16 aa, Artificial Sequence
  Synthesized molecular recognition unit - heavy CDR3
CARDHSSGWRHYFDYW

SEQ ID NO: 1896 - protein, 12 aa, Artificial Sequence
  Synthesized molecular recognition unit - heavy CDR3
CARDKGYAFDIW

SEQ ID NO: 1897 - protein, 8 aa, Artificial Sequence [sequence omitted]

SEQ ID NO: 1898 - protein, 12 aa, Artificial Sequence
  Synthesized molecular recognition unit - heavy CDR3
CARDLGGTADYW

SEQ ID NO: 1899 - protein, 12 aa, Artificial Sequence
  Synthesized molecular recognition unit - heavy CDR3
CARDLGGTADYW

SEQ ID NO: 1900 - protein, 12 aa, Artificial Sequence
  Synthesized molecular recognition unit - heavy CDR3
CARDLGGTADYW

SEQ ID NO: 1901 - protein, 18 aa, Artificial Sequence
  Synthesized molecular recognition unit - heavy CDR3
CARDLRNWGSPYWYFDLW

SEQ ID NO: 1902 - protein, 20 aa, Artificial Sequence
  Synthesized molecular recognition unit - heavy CDR3
CARDQDYGDYGWYYYGMDVW

SEQ ID NO: 1903 - protein, 20 aa, Artificial Sequence
  Synthesized molecular recognition unit - heavy CDR3
CARDQDYGDYGWYYYGMDVW

SEQ ID NO: 1904 - protein, 13 aa, Artificial Sequence
  Synthesized molecular recognition unit - heavy CDR3
CARDREQQILDYW

SEQ ID NO: 1905 - protein, 13 aa, Artificial Sequence
  Synthesized molecular recognition unit - heavy CDR3
CARDSDWGVVDPW

SEQ ID NO: 1906 - protein, 11 aa, Artificial Sequence [sequence omitted]

SEQ ID NO: 1907 - protein, 13 aa, Artificial Sequence
  Synthesized molecular recognition unit - heavy CDR3
CARDWELYGMDVW

SEQ ID NO: 1908 - protein, 21 aa, Artificial Sequence
  Synthesized molecular recognition unit - heavy CDR3
CARDWGIAAAGDYYYYGMDVW

SEQ ID NO: 1909 - protein, 21 aa, Artificial Sequence
  Synthesized molecular recognition unit - heavy CDR3
CARDWGIAAAGDYYYYGMDVW

SEQ ID NO: 1910 - protein, 14 aa, Artificial Sequence
  Synthesized molecular recognition unit - heavy CDR3
CARDYSDRSGIDYW

SEQ ID NO: 1911 - protein, 14 aa, Artificial Sequence
  Synthesized molecular recognition unit - heavy CDR3
CARDYSDRSGIDYW

SEQ ID NO: 1912 - protein, 18 aa, Artificial Sequence
  Synthesized molecular recognition unit - heavy CDR3
CARDYYGSGSYNYGMDVW

SEQ ID NO: 1913 - protein, 18 aa, Artificial Sequence
  Synthesized molecular recognition unit - heavy CDR3
CARDYYGSGSYNYGMDVW

SEQ ID NO: 1914 - protein, 16 aa, Artificial Sequence
  Synthesized molecular recognition unit - heavy CDR3
CAREAAEIPVGAFDIW

SEQ ID NO: 1915 - protein, 15 aa, Artificial Sequence
  Synthesized molecular recognition unit - heavy CDR3
CAREAYYYYYGMDVW

SEQ ID NO: 1916 - protein, 15 aa, Artificial Sequence
  Synthesized molecular recognition unit - heavy CDR3
CAREAYYYYYGMDVW

SEQ ID NO: 1917 - protein, 13 aa, Artificial Sequence
  Synthesized molecular recognition unit - heavy CDR3
CAREEGVGGMDVW

SEQ ID NO: 1918 - protein, 16 aa, Artificial Sequence
  Synthesized molecular recognition unit - heavy CDR3
CAREERGATGRAFDIW

SEQ ID NO: 1919 - protein, 12 aa, Artificial Sequence [sequence omitted]

SEQ ID NO: 1920 - protein, 22 aa, Artificial Sequence
  Synthesized molecular recognition unit - heavy CDR3
CARESALYSSSWYYYYYGMDVW

SEQ ID NO: 1921 - protein, 18 aa, Artificial Sequence
  Synthesized molecular recognition unit - heavy CDR3
CAREVAVKDYYYYYMDVW

SEQ ID NO: 1922 - protein, 13 aa, Artificial Sequence
  Synthesized molecular recognition unit - heavy CDR3
CAREYSYGYFRYW

SEQ ID NO: 1923 - protein, 11 aa, Artificial Sequence
  Synthesized molecular recognition unit - heavy CDR3
CARGDLEFDYW

SEQ ID NO: 1924 - protein, 15 aa, Artificial Sequence
  Synthesized molecular recognition unit - heavy CDR3
CARGEQWLVWGFDPW

SEQ ID NO: 1925 - protein, 10 aa, Artificial Sequence [sequence omitted]

SEQ ID NO: 1926 - protein, 18 aa, Artificial Sequence
  Synthesized molecular recognition unit - heavy CDR3
CARGGDSSGYYYYAFDIW

SEQ ID NO: 1927 - protein, 17 aa, Artificial Sequence
  Synthesized molecular recognition unit - heavy CDR3
CARGGGPNEHDYYFDYW

SEQ ID NO: 1928 - protein, 17 aa, Artificial Sequence
  Synthesized molecular recognition unit - heavy CDR3
CARGGNTYYYYYGMDVW

SEQ ID NO: 1929 - protein, 16 aa, Artificial Sequence
  Synthesized molecular recognition unit - heavy CDR3
CARGGSGSYYYAFDIW

SEQ ID NO: 1930 - protein, 16 aa, Artificial Sequence
  Synthesized molecular recognition unit - heavy CDR3
CARGGSGSYYYAFDIW

SEQ ID NO: 1931 - protein, 17 aa, Artificial Sequence
  Synthesized molecular recognition unit - heavy CDR3
CARGGSGWSNYYGMDVW

SEQ ID NO: 1932 - protein, 12 aa, Artificial Sequence
  Synthesized molecular recognition unit - heavy CDR3
CARGGYSTLDYW

SEQ ID NO: 1933 - protein, 12 aa, Artificial Sequence
  Synthesized molecular recognition unit - heavy CDR3
CARGGYSTLDYW

SEQ ID NO: 1934 - protein, 12 aa, Artificial Sequence
  Synthesized molecular recognition unit - heavy CDR3
CARGGYSTLDYW

SEQ ID NO: 1935 - protein, 18 aa, Artificial Sequence
  Synthesized molecular recognition unit - heavy CDR3
CARGLYKRYSYGYGMDVW

SEQ ID NO: 1936 - protein, 11 aa, Artificial Sequence
  Synthesized molecular recognition unit - heavy CDR3
CARGNLDFDYW

SEQ ID NO: 1937 - protein, 12 aa, Artificial Sequence
  Synthesized molecular recognition unit - heavy CDR3
CARGNPYYFDYW

SEQ ID NO: 1938 - protein, 17 aa, Artificial Sequence
  Synthesized molecular recognition unit - heavy CDR3
CARGPAAIGILGWFDPW

SEQ ID NO: 1939 - protein, 11 aa, Artificial Sequence [sequence omitted]

SEQ ID NO: 1940 - protein, 11 aa, Artificial Sequence [sequence omitted]

SEQ ID NO: 1941 - protein, 11 aa, Artificial Sequence [sequence omitted]

SEQ ID NO: 1942 - protein, 17 aa, Artificial Sequence
  Synthesized molecular recognition unit - heavy CDR3
CARGRGKKNYYYGMDVW

SEQ ID NO: 1943 - protein, 17 aa, Artificial Sequence
  Synthesized molecular recognition unit - heavy CDR3
CARGRGYSYGYYAFDIW

SEQ ID NO: 1944 - protein, 19 aa, Artificial Sequence
  Synthesized molecular recognition unit - heavy CDR3
CARGSDCSGGSCYYSFDYW

SEQ ID NO: 1945 - protein, 13 aa, Artificial Sequence
  Synthesized molecular recognition unit - heavy CDR3
CARGSGWSGLDYW

SEQ ID NO: 1946 - protein, 18 aa, Artificial Sequence
  Synthesized molecular recognition unit - heavy CDR3
CARGSGYYGPGYYGMDVW

SEQ ID NO: 1947 - protein, 11 aa, Artificial Sequence [sequence omitted]

SEQ ID NO: 1948 - protein, 11 aa, Artificial Sequence [sequence omitted]

SEQ ID NO: 1949 - protein, 18 aa, Artificial Sequence
  Synthesized molecular recognition unit - heavy CDR3
CARGTTGKGYYYYGMDVW

SEQ ID NO: 1950 - protein, 18 aa, Artificial Sequence
  Synthesized molecular recognition unit - heavy CDR3
CARGVSSGYYYYYGMDVW

SEQ ID NO: 1951 - protein, 11 aa, Artificial Sequence
  Synthesized molecular recognition unit - heavy CDR3
CARGYGDYDLW

SEQ ID NO: 1952 - protein, 11 aa, Artificial Sequence
  Synthesized molecular recognition unit - heavy CDR3
CARGYGDYDLW

SEQ ID NO: 1953 - protein, 11 aa, Artificial Sequence
  Synthesized molecular recognition unit - heavy CDR3
CARGYYDFDYW

SEQ ID NO: 1954 - protein, 18 aa, Artificial Sequence
  Synthesized molecular recognition unit - heavy CDR3
CARHLSSGYLSYYGMDVW

SEQ ID NO: 1955 - protein, 18 aa, Artificial Sequence
  Synthesized molecular recognition unit - heavy CDR3
CARHLSSGYLSYYGMDVW

SEQ ID NO: 1956 - protein, 24 aa, Artificial Sequence
  Synthesized molecular recognition unit - heavy CDR3
CARHPGSFGGYSYAWYYYYGMDVW

SEQ ID NO: 1957 - protein, 24 aa, Artificial Sequence
  Synthesized molecular recognition unit - heavy CDR3
CARHPGSFGGYSYAWYYYYGMDVW

SEQ ID NO: 1958 - protein, 15 aa, Artificial Sequence
  Synthesized molecular recognition unit - heavy CDR3
CARLDYGETEGNGDW

SEQ ID NO: 1959 - protein, 19 aa, Artificial Sequence
  Synthesized molecular recognition unit - heavy CDR3
CARLGSYGSPYYYYGMDVW

SEQ ID NO: 1960 - protein, 19 aa, Artificial Sequence
  Synthesized molecular recognition unit - heavy CDR3
CARLGSYGSPYYYYGMDVW

SEQ ID NO: 1961 - protein, 18 aa, Artificial Sequence
  Synthesized molecular recognition unit - heavy CDR3
CARLGSYPGPYYYYMDVW

SEQ ID NO: 1962 - protein, 18 aa, Artificial Sequence
  Synthesized molecular recognition unit - heavy CDR3
CARLGSYPGPYYYYMDVW

SEQ ID NO: 1963 - protein, 20 aa, Artificial Sequence
  Synthesized molecular recognition unit - heavy CDR3
CARRGGDVTVPAAYYAMDVW

SEQ ID NO: 1964 - protein, 18 aa, Artificial Sequence
  Synthesized molecular recognition unit - heavy CDR3
CARTLSGYSSSWYVFDYW

SEQ ID NO: 1965 - protein, 12 aa, Artificial Sequence [sequence omitted]

SEQ ID NO: 1966 - protein, 10 aa, Artificial Sequence
  Synthesized molecular recognition unit - heavy CDR3
CASAADFDYW

SEQ ID NO: 1967 - protein, 10 aa, Artificial Sequence
  Synthesized molecular recognition unit - heavy CDR3
CASAADFDYW

SEQ ID NO: 1968 - protein, 18 aa, Artificial Sequence
  Synthesized molecular recognition unit - heavy CDR3
CASAKNDFWSGYFAFDYW

SEQ ID NO: 1969 - protein, 14 aa, Artificial Sequence
  Synthesized molecular recognition unit - heavy CDR3
CASDIVVDDAFDTW

SEQ ID NO: 1970 - protein, 15 aa, Artificial Sequence
  Synthesized molecular recognition unit - heavy CDR3
CASGDTYDLYSLDVW

SEQ ID NO: 1971 - protein, 13 aa, Artificial Sequence
  Synthesized molecular recognition unit - heavy CDR3
CASGSYYSDFDYW

SEQ ID NO: 1972 - protein, 13 aa, Artificial Sequence
  Synthesized molecular recognition unit - heavy CDR3
CASGSYYSDFDYW

SEQ ID NO: 1973 - protein, 17 aa, Artificial Sequence
  Synthesized molecular recognition unit - heavy CDR3
CASGYSYGLYYYGMDVW

SEQ ID NO: 1974 - protein, 17 aa, Artificial Sequence
  Synthesized molecular recognition unit - heavy CDR3
CASGYSYGLYYYGMDVW

SEQ ID NO: 1975 - protein, 19 aa, Artificial Sequence
  Synthesized molecular recognition unit - heavy CDR3
CASSVVPAGPAGVYAFDIW

SEQ ID NO: 1976 - protein, 19 aa, Artificial Sequence
  Synthesized molecular recognition unit - heavy CDR3
CASSVVPAGPAGVYAFDIW

SEQ ID NO: 1977 - protein, 13 aa, Artificial Sequence
  Synthesized molecular recognition unit - heavy CDR3
CASTVTTDAFDIW

SEQ ID NO: 1978 - protein, 13 aa, Artificial Sequence
  Synthesized molecular recognition unit - heavy CDR3
CASTVTTDAFDIW

SEQ ID NO: 1979 - protein, 11 aa, Artificial Sequence
  Synthesized molecular recognition unit - heavy CDR3
CASYFGVMDVW

SEQ ID NO: 1980 - protein, 15 aa, Artificial Sequence
  Synthesized molecular recognition unit - heavy CDR3
CATAYGSSSLNIDYW

SEQ ID NO: 1981 - protein, 15 aa, Artificial Sequence
  Synthesized molecular recognition unit - heavy CDR3
CATAYGSSSLNIDYW

SEQ ID NO: 1982 - protein, 15 aa, Artificial Sequence
  Synthesized molecular recognition unit - heavy CDR3
CATAYGSSSLNIDYW

SEQ ID NO: 1983 - protein, 15 aa, Artificial Sequence
  Synthesized molecular recognition unit - heavy CDR3
CATDEYSSSYAFDIW

SEQ ID NO: 1984 - protein, 15 aa, Artificial Sequence [sequence omitted]

SEQ ID NO: 1985 - protein, 13 aa, Artificial Sequence
  Synthesized molecular recognition unit - heavy CDR3
CATEAALDAFDIW

SEQ ID NO: 1986 - protein, 13 aa, Artificial Sequence
  Synthesized molecular recognition unit - heavy CDR3
CATEAALDAFDIW

SEQ ID NO: 1987 - protein, 9 aa, Artificial Sequence
  Synthesized molecular recognition unit - heavy CDR3
CATGPNSIY

SEQ ID NO: 1988 - protein, 9 aa, Artificial Sequence
  Synthesized molecular recognition unit - heavy CDR3
CATGPNSIY

SEQ ID NO: 1989 - protein, 19 aa, Artificial Sequence
  Synthesized molecular recognition unit - heavy CDR3
CATRRPFNSYNTEQSYDSW

SEQ ID NO: 1990 - protein, 19 aa, Artificial Sequence
  Synthesized molecular recognition unit - heavy CDR3
CATRRPFNSYNTEQSYDSW

SEQ ID NO: 1991 - protein, 19 aa, Artificial Sequence
  Synthesized molecular recognition unit - heavy CDR3
CATRTGYSYGFNFWAFDIW

SEQ ID NO: 1992 - protein, 19 aa, Artificial Sequence
  Synthesized molecular recognition unit - heavy CDR3
CATRTGYSYGFNFWAFDIW

SEQ ID NO: 1993 - protein, 14 aa, Artificial Sequence
  Synthesized molecular recognition unit - heavy CDR3
CATSPYGVFTLDYW

SEQ ID NO: 1994 - protein, 14 aa, Artificial Sequence
  Synthesized molecular recognition unit - heavy CDR3
CATSPYGVFTLDYW

SEQ ID NO: 1995 - protein, 16 aa, Artificial Sequence
  Synthesized molecular recognition unit - heavy CDR3
CATVTGYSSAGAFDIW

SEQ ID NO: 1996 - protein, 11 aa, Artificial Sequence
  Synthesized molecular recognition unit - heavy CDR3
CAVVDDAFDIW

SEQ ID NO: 1997 - protein, 11 aa, Artificial Sequence
  Synthesized molecular recognition unit - heavy CDR3
CAVVDDAFDIW

SEQ ID NO: 1998 - protein, 7 aa, Artificial Sequence
  Synthesized molecular recognition unit - heavy CDR3
CGSRGYW

SEQ ID NO: 1999 - protein, 15 aa, Artificial Sequence
  Synthesized molecular recognition unit - heavy CDR3
CHAKQLRNGQMYTYW

SEQ ID NO: 2000 - protein, 15 aa, Artificial Sequence
  Synthesized molecular recognition unit - heavy CDR3
CHAVENILGRFVDYW

SEQ ID NO: 2001 - protein, 14 aa, Artificial Sequence
  Synthesized molecular recognition unit - heavy CDR3
CHGRDYGSNAPQYW

SEQ ID NO: 2002 - protein, 14 aa, Artificial Sequence
  Synthesized molecular recognition unit - heavy CDR3
CKAAPRWGGATAYW

SEQ ID NO: 2003 - protein, 14 aa, Artificial Sequence
  Synthesized molecular recognition unit - heavy CDR3
CKIYGLNGQPLGSW

SEQ ID NO: 2004 - protein, 19 aa, Artificial Sequence
  Synthesized molecular recognition unit - heavy CDR3
CKLQVRPIGYSSAYSRNYW

SEQ ID NO: 2005 - protein, 9 aa, Artificial Sequence
  Synthesized molecular recognition unit - heavy CDR3
CKQHPNGYR

SEQ ID NO: 2006 - protein, 18 aa, Artificial Sequence
  Synthesized molecular recognition unit - heavy CDR3
CNAASTVTAWPYYGPDYW

SEQ ID NO: 2007 - protein, 18 aa, Artificial Sequence
  Synthesized molecular recognition unit - heavy CDR3
CNAASTVTAWPYYGPDYW

SEQ ID NO: 2008 - protein, 19 aa, Artificial Sequence
  Synthesized molecular recognition unit - heavy CDR3
CNADGYSWDGRSGRRLELW

SEQ ID NO: 2009 - protein, 17 aa, Artificial Sequence
  Synthesized molecular recognition unit - heavy CDR3
CNADIKTTTYSPLRNYW

SEQ ID NO: 2010 - protein, 12 aa, Artificial Sequence
  Synthesized molecular recognition unit - heavy CDR3
CNAETYSGNTIW

SEQ ID NO: 2011 - protein, 16 aa, Artificial Sequence
  Synthesized molecular recognition unit - heavy CDR3
CNAFVRSDFDRYYDYW

SEQ ID NO: 2012 - protein, 14 aa, Artificial Sequence
  Synthesized molecular recognition unit - heavy CDR3
CNAKRPWGSRDEYW

SEQ ID NO: 2013 - protein, 14 aa, Artificial Sequence
  Synthesized molecular recognition unit - heavy CDR3
CNAKRPWGSRDEYW

SEQ ID NO: 2014 - protein, 14 aa, Artificial Sequence
  Synthesized molecular recognition unit - heavy CDR3
CNAKRPWGSRDEYW

SEQ ID NO: 2015 - protein, 14 aa, Artificial Sequence
  Synthesized molecular recognition unit - heavy CDR3
CNAKRPWGSRDEYW

SEQ ID NO: 2016 - protein, 14 aa, Artificial Sequence
  Synthesized molecular recognition unit - heavy CDR3
CNAKRPWGTRDEYW

SEQ ID NO: 2017 - protein, 14 aa, Artificial Sequence
  Synthesized molecular recognition unit - heavy CDR3
CNAKRPWGTRDEYW

SEQ ID NO: 2018 - protein, 14 aa, Artificial Sequence
  Synthesized molecular recognition unit - heavy CDR3
CNAKRPWGTRDEYW

SEQ ID NO: 2019 - protein, 11 aa, Artificial Sequence
  Synthesized molecular recognition unit - heavy CDR3
CNANYRGNRYW

SEQ ID NO: 2020 - protein, 13 aa, Artificial Sequence
  Synthesized molecular recognition unit - heavy CDR3
CNAPAWLYDDDYW

SEQ ID NO: 2021 - protein, 12 aa, Artificial Sequence
  Synthesized molecular recognition unit - heavy CDR3
CNAVTFGGNTIR

SEQ ID NO: 2022 - protein, 9 aa, Artificial Sequence
  Synthesized molecular recognition unit - heavy CDR3
CNAVTYDGY

SEQ ID NO: 2023 - protein, 12 aa, Artificial Sequence
  Synthesized molecular recognition unit - heavy CDR3
CNAVTYNGYTIR

SEQ ID NO: 2024 - protein, 16 aa, Artificial Sequence
  Synthesized molecular recognition unit - heavy CDR3
CNAVVVGLSRRIDNIW

SEQ ID NO: 2025 - protein, 10 aa, Artificial Sequence
  Synthesized molecular recognition unit - heavy CDR3
CNKVNAITKL

SEQ ID NO: 2026 - protein, 14 aa, Artificial Sequence
  Synthesized molecular recognition unit - heavy CDR3
CNLREWNNSGAGYW

SEQ ID NO: 2027 - protein, 11 aa, Artificial Sequence
  Synthesized molecular recognition unit - heavy CDR3
CNTSPYMHDVW

SEQ ID NO: 2028 - protein, 11 aa, Artificial Sequence
  Synthesized molecular recognition unit - heavy CDR3
CNTSPYMHDVW

SEQ ID NO: 2029 - protein, 10 aa, Artificial Sequence
  Synthesized molecular recognition unit - heavy CDR3
CNTVRPLWAW

SEQ ID NO: 2030 - protein, 16 aa, Artificial Sequence
  Synthesized molecular recognition unit - heavy CDR3
CNTYPFPIYKKGYPFW

SEQ ID NO: 2031 - protein, 15 aa, Artificial Sequence
  Synthesized molecular recognition unit - heavy CDR3
CNVDRTLYGKYKEYW

SEQ ID NO: 2032 - protein, 16 aa, Artificial Sequence
  Synthesized molecular recognition unit - heavy CDR3
CSKGGVYGGTYVPDSW

SEQ ID NO: 2033 - protein, 16 aa, Artificial Sequence
  Synthesized molecular recognition unit - heavy CDR3
CSKGGVYGGTYVPDSW

SEQ ID NO: 2034 - protein, 7 aa, Artificial Sequence
  Synthesized molecular recognition unit - heavy CDR3
CSSRGYW

SEQ ID NO: 2035 - protein, 7 aa, Artificial Sequence
  Synthesized molecular recognition unit - heavy CDR3
CSSRGYW

SEQ ID NO: 2036 - protein, 21 aa, Artificial Sequence
  Synthesized molecular recognition unit - heavy CDR3
CTAGRSRYLYGSSLNGPYDYW

SEQ ID NO: 2037 - protein, 7 aa, Artificial Sequence
  Synthesized molecular recognition unit - heavy CDR3
CTKGGIQ

SEQ ID NO: 2038 - protein, 11 aa, Artificial Sequence
  Synthesized molecular recognition unit - heavy CDR3
CTLVNEIKTWW

SEQ ID NO: 2039 - protein, 11 aa, Artificial Sequence
  Synthesized molecular recognition unit - heavy CDR3
CTLVNEIKTWW

SEQ ID NO: 2040 - protein, 11 aa, Artificial Sequence
  Synthesized molecular recognition unit - heavy CDR3
CTLVNEIKTWW

SEQ ID NO: 2041 - protein, 11 aa, Artificial Sequence
  Synthesized molecular recognition unit - heavy CDR3
CTLVNEIKTWW

SEQ ID NO: 2042 - protein, 15 aa, Artificial Sequence
  Synthesized molecular recognition unit - heavy CDR3
CTREHSYYYYGMDVW

SEQ ID NO: 2043 - protein, 11 aa, Artificial Sequence
  Synthesized molecular recognition unit - heavy CDR3
CTRVAWGLDYW

SEQ ID NO: 2044 - protein, 23 aa, Artificial Sequence
  Synthesized molecular recognition unit - heavy CDR3
CTTAGYKAARRSVYPRIFNFDYW

SEQ ID NO: 2045 - protein, 15 aa, Artificial Sequence
  Synthesized molecular recognition unit - heavy CDR3
CTTDDYGDLTHLDYW

SEQ ID NO: 2046 - protein, 15 aa, Artificial Sequence
  Synthesized molecular recognition unit - heavy CDR3
CTTDDYGDQYGMDVW

SEQ ID NO: 2047 - protein, 9 aa, Artificial Sequence
  Synthesized molecular recognition unit - heavy CDR3
CTTDLWDYW

SEQ ID NO: 2048 - protein, 9 aa, Artificial Sequence
  Synthesized molecular recognition unit - heavy CDR3
CTTDLWDYW

SEQ ID NO: 2049 - protein, 17 aa, Artificial Sequence
  Synthesized molecular recognition unit - heavy CDR3
CVKDGGSFPLAYAFDIW

SEQ ID NO: 2050 - protein, 17 aa, Artificial Sequence
  Synthesized molecular recognition unit - heavy CDR3
CVKDGGSFPLAYAFDIW

SEQ ID NO: 2051 - protein, 17 aa, Artificial Sequence
  Synthesized molecular recognition unit - heavy CDR3
CVKDGGSFPLAYAFDIW

SEQ ID NO: 2052 - protein, 18 aa, Artificial Sequence
  Synthesized molecular recognition unit - heavy CDR3
CVRGDSGWGILYYVMDVW

SEQ ID NO: 2053 - protein, 12 aa, Artificial Sequence
  Synthesized molecular recognition unit - heavy CDR3
CVRYAWPEFDHW

SEQ ID NO: 2054 - protein, 12 aa, Artificial Sequence
  Synthesized molecular recognition unit - heavy CDR3
CVRYAWPEFDHW

SEQ ID NO: 2055 - protein, 12 aa, Artificial Sequence
  Synthesized molecular recognition unit - heavy CDR3
CVRYAWPEFDHW

SEQ ID NO: 2056 - protein, 10 aa, Artificial Sequence
  Synthesized molecular recognition unit - heavy CDR3
CVYGRDFDYW

SEQ ID NO: 2057 - protein, 17 aa, Artificial Sequence
  Synthesized molecular recognition unit - heavy CDR3
CYADSRSSWYDEYLEHW

SEQ ID NO: 2058 - protein, 17 aa, Artificial Sequence
  Synthesized molecular recognition unit - heavy CDR3
CYADSRSSWYDEYLEHW

SEQ ID NO: 2059 - protein, 16 aa, Artificial Sequence
  Synthesized molecular recognition unit - heavy CDR3
CYANIYYTRRAPEEYW

SEQ ID NO: 2060 - protein, 15 aa, Artificial Sequence
  Synthesized molecular recognition unit - heavy CDR3
CYARTQRMGVVNSYW

SEQ ID NO: 2061 - protein, 17 aa, Artificial Sequence
  Synthesized molecular recognition unit - heavy CDR3
CYARTVIGGFGAFRAHW

SEQ ID NO: 2062 - protein, 17 aa, Artificial Sequence
  Synthesized molecular recognition unit - heavy CDR3
CYARTVIGGFGAFRAHW

SEQ ID NO: 2063 - protein, 17 aa, Artificial Sequence
  Synthesized molecular recognition unit - heavy CDR3
CYARTVIGGFGAFRAHW

SEQ ID NO: 2064 - protein, 18 aa, Artificial Sequence
  Synthesized molecular recognition unit - heavy CDR3
CYRRQWASSWGARNYEYW

SEQ ID NO: 2065 - protein, 13 aa, Artificial Sequence
  Synthesized molecular recognition unit - heavy CDR3
CYVKLRDDDYVYR

SEQ ID NO: 2066 - protein, 12 aa, Artificial Sequence
  Synthesized molecular recognition unit - light CDR1
GASQSVPRNSLA

SEQ ID NO: 2067 - protein, 11 aa, Artificial Sequence
  Synthesized molecular recognition unit - light CDR1
HGSQDISNYLN

SEQ ID NO: 2068 - skipped

SEQ ID NO: 2069 - protein, 17 aa, Artificial Sequence
  Synthesized molecular recognition unit - light CDR1
KSSHSLLSTSTNRNHLA

SEQ ID NO: 2070 - protein, 17 aa, Artificial Sequence
  Synthesized molecular recognition unit - light CDR1
KSSHSLLSTSTNRNQLA

SEQ ID NO: 2071 - protein, 17 aa, Artificial Sequence
  Synthesized molecular recognition unit - light CDR1
KSSHSLLYSSDNKNYLA

SEQ ID NO: 2072 - protein, 17 aa, Artificial Sequence
  Synthesized molecular recognition unit - light CDR1
KSSQSILSSSSNRDSLA

SEQ ID NO: 2073 - protein, 17 aa, Artificial Sequence
  Synthesized molecular recognition unit - light CDR1
KSSQSVLYTTTNRNHIA

SEQ ID NO: 2074 - protein, 17 aa, Artificial Sequence
  Synthesized molecular recognition unit - light CDR1
KSSQSVLYTTTNRNHIA

SEQ ID NO: 2075 - protein, 11 aa, Artificial Sequence
  Synthesized molecular recognition unit - light CDR1
QASQDIANYLN

SEQ ID NO: 2076 - protein, 11 aa, Artificial Sequence
  Synthesized molecular recognition unit - light CDR1
QASQDISNYLA

SEQ ID NO: 2077 - protein, 11 aa, Artificial Sequence
  Synthesized molecular recognition unit - light CDR1
QASQDISNYLN

SEQ ID NO: 2078 - protein, 11 aa, Artificial Sequence
  Synthesized molecular recognition unit - light CDR1
QASQGITNYLN

SEQ ID NO: 2079 - protein, 11 aa, Artificial Sequence
  Synthesized molecular recognition unit - light CDR1
RASQDISNYLN

SEQ ID NO: 2080 - protein, 11 aa, Artificial Sequence
  Synthesized molecular recognition unit - light CDR1
RASQDISSYLA

SEQ ID NO: 2081 - protein, 11 aa, Artificial Sequence
  Synthesized molecular recognition unit - light CDR1
RASQGINSYLA

SEQ ID NO: 2082 - protein, 11 aa, Artificial Sequence
  Synthesized molecular recognition unit - light CDR1
RASQGISNNLN

SEQ ID NO: 2083 - protein, 11 aa, Artificial Sequence
  Synthesized molecular recognition unit - light CDR1
RASQGISNYLA

SEQ ID NO: 2084 - protein, 11 aa, Artificial Sequence
  Synthesized molecular recognition unit - light CDR1
RASQGISNYLN

SEQ ID NO: 2085 - protein, 11 aa, Artificial Sequence
  Synthesized molecular recognition unit - light CDR1
RASQGISRDLA

SEQ ID NO: 2086 - protein, 11 aa, Artificial Sequence
  Synthesized molecular recognition unit - light CDR1
RASQGISSALA

SEQ ID NO: 2087 - protein, 11 aa, Artificial Sequence
  Synthesized molecular recognition unit - light CDR1
RASQGISSYLA

SEQ ID NO: 2088 - protein, 11 aa, Artificial Sequence
  Synthesized molecular recognition unit - light CDR1
RASQNIGLYLN

SEQ ID NO: 2089 - protein, 11 aa, Artificial Sequence
  Synthesized molecular recognition unit - light CDR1
RASQRVSNYLN

SEQ ID NO: 2090 - protein, 11 aa, Artificial Sequence
  Synthesized molecular recognition unit - light CDR1
RASQSISNYLN

SEQ ID NO: 2091 - protein, 11 aa, Artificial Sequence
  Synthesized molecular recognition unit - light CDR1
RASQSISRWLA

SEQ ID NO: 2092 - protein, 11 aa, Artificial Sequence
  Synthesized molecular recognition unit - light CDR1
RASQSISRYLN

SEQ ID NO: 2093 - protein, 11 aa, Artificial Sequence
  Synthesized molecular recognition unit - light CDR1
RASQSISSYLA

SEQ ID NO: 2094 - protein, 11 aa, Artificial Sequence
  Synthesized molecular recognition unit - light CDR1
RASQSISSYLN

SEQ ID NO: 2095 - protein, 11 aa, Artificial Sequence
  Synthesized molecular recognition unit - light CDR1
RASQSIZNYLN

SEQ ID NO: 2096 - protein, 12 aa, Artificial Sequence
  Synthesized molecular recognition unit - light CDR1
RASQSVRSSDLA

SEQ ID NO: 2097 - protein, 11 aa, Artificial Sequence
  Synthesized molecular recognition unit - light CDR1
RASQSVYSNLA

SEQ ID NO: 2098 - protein, 11 aa, Artificial Sequence
  Synthesized molecular recognition unit - light CDR1
RASQYISNYLN

SEQ ID NO: 2099 - protein, 11 aa, Artificial Sequence
  Synthesized molecular recognition unit - light CDR1
RASRNINRYLN

SEQ ID NO: 2100 - protein, 11 aa, Artificial Sequence
  Synthesized molecular recognition unit - light CDR1
RPSQSIGSWLA

SEQ ID NO: 2101 - protein, 16 aa, Artificial Sequence
  Synthesized molecular recognition unit - light CDR1
RSSQSLLHSDGYTYLY

SEQ ID NO: 2102 - protein, 16 aa, Artificial Sequence
  Synthesized molecular recognition unit - light CDR1
RSSQSLLHSNGYNYLD

SEQ ID NO: 2103 - protein, 11 aa, Artificial Sequence
  Synthesized molecular recognition unit - light CDR1
RVSQSISSYLN

SEQ ID NO: 2104 - protein, 11 aa, Artificial Sequence
  Synthesized molecular recognition unit - light CDR1
RZSQSZSZYLN

SEQ ID NO: 2105 - protein, 13 aa, Artificial Sequence
  Synthesized molecular recognition unit - light CDR1
SGSSSNVGNNYVS

SEQ ID NO: 2106 - protein, 12 aa, Artificial Sequence
  Synthesized molecular recognition unit - light CDR1
WASQSVRGNYVA

SEQ ID NO: 2107 - protein, 7 aa, Artificial Sequence
  Synthesized molecular recognition unit - light CDR2
AASILQS

SEQ ID NO: 2108 - protein, 7 aa, Artificial Sequence
  Synthesized molecular recognition unit - light CDR2
AASSLHS

SEQ ID NO: 2109 - protein, 7 aa, Artificial Sequence
  Synthesized molecular recognition unit - light CDR2
AASSLLS

SEQ ID NO: 2110 - protein, 7 aa, Artificial Sequence
  Synthesized molecular recognition unit - light CDR2
AASSLQS

SEQ ID NO: 2111 - protein, 7 aa, Artificial Sequence
  Synthesized molecular recognition unit - light CDR2
AASTLES

SEQ ID NO: 2112 - protein, 7 aa, Artificial Sequence
  Synthesized molecular recognition unit - light CDR2
AASTLQR

SEQ ID NO: 2113 - protein, 7 aa, Artificial Sequence
  Synthesized molecular recognition unit - light CDR2
AASTLQS

SEQ ID NO: 2114 - protein, 7 aa, Artificial Sequence
  Synthesized molecular recognition unit - light CDR2
DAKGLHP

SEQ ID NO: 2115 - protein, 7 aa, Artificial Sequence
  Synthesized molecular recognition unit - light CDR2
DASNLET

SEQ ID NO: 2116 - protein, 7 aa, Artificial Sequence
  Synthesized molecular recognition unit - light CDR2
DASNLQS

SEQ ID NO: 2117 - protein, 7 aa, Artificial Sequence
  Synthesized molecular recognition unit - light CDR2
DASNRAA

SEQ ID NO: 2118 - protein, 7 aa, Artificial Sequence
  Synthesized molecular recognition unit - light CDR2
DASNRAG

SEQ ID NO: 2119 - protein, 7 aa, Artificial Sequence
  Synthesized molecular recognition unit - light CDR2
DASNRQS

SEQ ID NO: 2120 - protein, 7 aa, Artificial Sequence
  Synthesized molecular recognition unit - light CDR2
DASSLES

SEQ ID NO: 2121 - protein, 7 aa, Artificial Sequence
  Synthesized molecular recognition unit - light CDR2
DASSLQR

SEQ ID NO: 2122 - protein, 7 aa, Artificial Sequence
  Synthesized molecular recognition unit - light CDR2
DNDKRPS

SEQ ID NO: 2123 - protein, 7 aa, Artificial Sequence
  Synthesized molecular recognition unit - light CDR2
DTSNRAT

SEQ ID NO: 2124 - protein, 7 aa, Artificial Sequence
  Synthesized molecular recognition unit - light CDR2
GASQRAT

SEQ ID NO: 2125 - protein, 7 aa, Artificial Sequence
  Synthesized molecular recognition unit - light CDR2
GASTRAT

SEQ ID NO: 2126 - protein, 7 aa, Artificial Sequence
  Synthesized molecular recognition unit - light CDR2
GSSSRAT

SEQ ID NO: 2127 - protein, 7 aa, Artificial Sequence
  Synthesized molecular recognition unit - light CDR2
GSSTLQS

SEQ ID NO: 2128 - protein, 7 aa, Artificial Sequence
  Synthesized molecular recognition unit - light CDR2
GTSNLQS

SEQ ID NO: 2129 - protein, 7 aa, Artificial Sequence
  Synthesized molecular recognition unit - light CDR2
GTSSLHT

SEQ ID NO: 2130 - protein, 7 aa, Artificial Sequence
  Synthesized molecular recognition unit - light CDR2
KASSLES

SEQ ID NO: 2131 - protein, 7 aa, Artificial Sequence
  Synthesized molecular recognition unit - light CDR2
LGSNRAS

SEQ ID NO: 2132 - protein, 7 aa, Artificial Sequence
  Synthesized molecular recognition unit - light CDR2
SASSLQS

SEQ ID NO: 2133 - protein, 7 aa, Artificial Sequence
  Synthesized molecular recognition unit - light CDR2
SASTLQS

SEQ ID NO: 2134 - protein, 7 aa, Artificial Sequence
  Synthesized molecular recognition unit - light CDR2
TLSYRAS

SEQ ID NO: 2135 - protein, 7 aa, Artificial Sequence
  Synthesized molecular recognition unit - light CDR2
WASSRKS

SEQ ID NO: 2136 - protein, 7 aa, Artificial Sequence
  Synthesized molecular recognition unit - light CDR2
WSSTRES

SEQ ID NO: 2137 - protein, 7 aa, Artificial Sequence
  Synthesized molecular recognition unit - light CDR2
ZASSLQS

SEQ ID NO: 2138 - protein, 7 aa, Artificial Sequence
  Synthesized molecular recognition unit - light CDR2
ZASTLES

SEQ ID NO: 2139 - protein, 13 aa, Artificial Sequence
  Synthesized molecular recognition unit - light CDR3
CESWDSSLSSEVF

SEQ ID NO: 2140 - protein, 11 aa, Artificial Sequence
  Synthesized molecular recognition unit - light CDR3
CLQDFSFPWTF

SEQ ID NO: 2141 - protein, 11 aa, Artificial Sequence [sequence omitted]

SEQ ID NO: 2142 - protein, 11 aa, Artificial Sequence
  Synthesized molecular recognition unit - light CDR3
CLQDYTDPFTF

SEQ ID NO: 2143 - protein, 11 aa, Artificial Sequence [sequence omitted]

SEQ ID NO: 2144 - protein, 11 aa, Artificial Sequence
  Synthesized molecular recognition unit - light CDR3
CMQALEALFTF

SEQ ID NO: 2145 - protein, 11 aa, Artificial Sequence [sequence omitted]

SEQ ID NO: 2146 - protein, 11 aa, Artificial Sequence [sequence omitted]

SEQ ID NO: 2147 - protein, 11 aa, Artificial Sequence [sequence omitted]

SEQ ID NO: 2148 - protein, 11 aa, Artificial Sequence [sequence omitted]

SEQ ID NO: 2149 - protein, 10 aa, Artificial Sequence [sequence omitted]

SEQ ID NO: 2150 - protein, 11 aa, Artificial Sequence
  Synthesized molecular recognition unit - light CDR3
CQQAYSFPWTF

SEQ ID NO: 2151 - protein, 11 aa, Artificial Sequence
  Synthesized molecular recognition unit - light CDR3
CQQFDRSPLTF

SEQ ID NO: 2152 - protein, 11 aa, Artificial Sequence [sequence omitted]

SEQ ID NO: 2153 - protein, 11 aa, Artificial Sequence
  Synthesized molecular recognition unit - light CDR3
CQQGYGTPPMF

SEQ ID NO: 2154 - protein, 11 aa, Artificial Sequence
  Synthesized molecular recognition unit - light CDR3
CQQGYNTPRTF

SEQ ID NO: 2155 - protein, 11 aa, Artificial Sequence
  Synthesized molecular recognition unit - light CDR3
CQQIHSYPLTF

SEQ ID NO: 2156 - protein, 11 aa, Artificial Sequence [sequence omitted]

SEQ ID NO: 2157 - protein, 11 aa, Artificial Sequence [sequence omitted]

SEQ ID NO: 2158 - protein, 11 aa, Artificial Sequence [sequence omitted]

SEQ ID NO: 2159 - protein, 11 aa, Artificial Sequence [sequence omitted]

SEQ ID NO: 2160 - protein, 11 aa, Artificial Sequence [sequence omitted]

SEQ ID NO: 2161 - protein, 11 aa, Artificial Sequence [sequence omitted]

SEQ ID NO: 2162 - protein, 11 aa, Artificial Sequence [sequence omitted]

SEQ ID NO: 2163 - protein, 11 aa, Artificial Sequence
  Synthesized molecular recognition unit - light CDR3
CQQSYRIHWTF

SEQ ID NO: 2164 - protein, 11 aa, Artificial Sequence [sequence omitted]

SEQ ID NO: 2165 - protein, 10 aa, Artificial Sequence
  Synthesized molecular recognition unit - light CDR3
CQQSYRYPTF

SEQ ID NO: 2166 - protein, 11 aa, Artificial Sequence [sequence omitted]

SEQ ID NO: 2167 - protein, 11 aa, Artificial Sequence [sequence omitted]

SEQ ID NO: 2168 - protein, 12 aa, Artificial Sequence
  Synthesized molecular recognition unit - light CDR3
CQQSYSFPPFTF

SEQ ID NO: 2169 - protein, 11 aa, Artificial Sequence [sequence omitted]

SEQ ID NO: 2170 - protein, 11 aa, Artificial Sequence [sequence omitted]

SEQ ID NO: 2171 - protein, 11 aa, Artificial Sequence [sequence omitted]

SEQ ID NO: 2172 - protein, 11 aa, Artificial Sequence [sequence omitted]

SEQ ID NO: 2173 - protein, 11 aa, Artificial Sequence [sequence omitted]

SEQ ID NO: 2174 - protein, 11 aa, Artificial Sequence [sequence omitted]

SEQ ID NO: 2175 - protein, 11 aa, Artificial Sequence [sequence omitted]

SEQ ID NO: 2176 - protein, 11 aa, Artificial Sequence [sequence omitted]

SEQ ID NO: 2177 - protein, 11 aa, Artificial Sequence [sequence omitted]

SEQ ID NO: 2178 - protein, 11 aa, Artificial Sequence [sequence omitted]

SEQ ID NO: 2179 - protein, 11 aa, Artificial Sequence
  Synthesized molecular recognition unit - light CDR3
CQQSYTSRLTF

SEQ ID NO: 2180 - protein, 11 aa, Artificial Sequence [sequence omitted]

SEQ ID NO: 2181 - protein, 11 aa, Artificial Sequence [sequence omitted]

SEQ ID NO: 2182 - protein, 11 aa, Artificial Sequence
  Synthesized molecular recognition unit - light CDR3
CQQTYTIPFTF

SEQ ID NO: 2183 - protein, 12 aa, Artificial Sequence [sequence omitted]

SEQ ID NO: 2184 - protein, 13 aa, Artificial Sequence
  Synthesized molecular recognition unit - light CDR3
CQQYHNWPPEYTF

SEQ ID NO: 2185 - protein, 12 aa, Artificial Sequence [sequence omitted]

SEQ ID NO: 2186 - protein, 11 aa, Artificial Sequence [sequence omitted]

SEQ ID NO: 2187 - protein, 11 aa, Artificial Sequence [sequence omitted]

SEQ ID NO: 2188 - protein, 11 aa, Artificial Sequence [sequence omitted]

SEQ ID NO: 2189 - protein, 11 aa, Artificial Sequence [sequence omitted]

SEQ ID NO: 2190 - protein, 90 aa, Homo sapiens
KMYHTKGQEGSVCLRSSDCASGLCCARHFWSKICKPVLKEGQVCTKHRRKGSHGLEIFQRCYCGEGLSCRIQKDHHQASNSSRLHTCQRH

SEQ ID NO: 2191 - protein, 88 aa, Homo sapiens
KMSHIKGHEGDPCLRSSDCIEGFCCARHFWTKICKPVLHQGEVCTKQRKKGSHGLEIFQRCDCAKGLSCKVWKDATYSSKARLHVCQK

SEQ ID NO: 2192 - protein, 500 aa, Artificial Sequence
  Made in Lab - Nab-Nab-Fc construct
MDMRVPAQLLGLLLLWLRGARCDVQLVESGGGLVQAGGSLRLACAGSGRIFAIYDIAWYRHPPGNQRELVAMIRPVVTEIDYADSVKGRFTISRNNAMKTVYLQMNNLKPEDTAVYYCNAKRPWGSRDEYWGQGTQVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGKGGSGSAVQQVESGGGLVQPGGSLRLSCAASGFTLDYYAISWFRQAPGKKRELVADITSGGSTNYADSVKGRFTISRDNAKNTIYLQMNSLKPEDTAVYFCNAVTYNGYTIWGQGTQVTVSSGSGSGHHHHHH

SEQ ID NO: 2193 - protein, 488 aa, Artificial Sequence
  Made in Lab - Nab-Nab-Fc construct
MDMRVPAQLLGLLLLWLRGARAVQQVESGGGLVQPGGSLRLSCAASGFTLDYYAISWFRQAPGKKRELVADITSGGSTNYADSVKGRFTISRDNAKNTIYLQMNSLKPEDTAVYFCNAVTYNGYTIWGQGTQVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGKGGSGSDVQLVESGGGLVQAGGSLRLACAGSGRIFAIYDIAWYRHPPGNQRELVAMIRPVVTEIDYADSVKGRFTISRNNAMKTVYLQMNNLKPEDTAVYYCNAKRPWGSRDEYWGQGTQVTVSS

SEQ ID NO: 2194 - protein, 489 aa, Artificial Sequence
  Made in Lab - Nab-Nab-Fc construct
MDMRVPAQLLGLLLLWLRGARCDVQLVESGGGLVQAGGSLRLACAGSGRIFAIYDIAWYRHPPGNQRELVAMIRPVVTEIDYADSVKGRFTISRNNAMKTVYLQMNNLKPEDTAVYYCNAKRPWGSRDEYWGQGTQVTVSSGGSGSAVQQVESGGGLVQPGGSLRLSCAASGFTLDYYAISWFRQAPGKKRELVADITSGGSTNYADSVKGRFTISRDNAKNTIYLQMNSLKPEDTAVYFCNAVTYNGYTIWGQGTQVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2195 - protein, 494 aa, Artificial Sequence
  Made in Lab - Nab-Nab-Fc construct
MDMRVPAQLLGLLLLWLRGARCDVQLVESGGGLVQAGGSLRLACAGSGRIFAIYDIAWYRHPPGNQRELVAMIRPVVTEIDYADSVKGRFTISRNNAMKTVYLQMNNLKPEDTAVYYCNAKRPWGSRDEYWGQGTQVTVSSGSSGSGGSGSAVQQVESGGGLVQPGGSLRLSCAASGFTLDYYAISWFRQAPGKKRELVADITSGGSTNYADSVKGRFTISRDNAKNTIYLQMNSLKPEDTAVYFCNAVTYNGYTIWGQGTQVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2196 - protein, 499 aa, Artificial Sequence
  Made in Lab - Nab-Nab-Fc construct
MDMRVPAQLLGLLLLWLRGARCDVQLVESGGGLVQAGGSLRLACAGSGRIFAIYDIAWYRHPPGNQRELVAMIRPVVTEIDYADSVKGRFTISRNNAMKTVYLQMNNLKPEDTAVYYCNAKRPWGSRDEYWGQGTQVTVSSGSSGSGGGGSGGSGSAVQQVESGGGLVQPGGSLRLSCAASGFTLDYYAISWFRQAPGKKRELVADITSGGSTNYADSVKGRFTISRDNAKNTIYLQMNSLKPEDTAVYFCNAVTYNGYTIWGQGTQVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2197 - protein, 489 aa, Artificial Sequence
  Made in Lab - Nab-Nab-Fc construct
MDMRVPAQLLGLLLLWLRGARCAVQQVESGGGLVQPGGSLRLSCAASGFTLDYYAISWFRQAPGKKRELVADITSGGSTNYADSVKGRFTISRDNAKNTIYLQMNSLKPEDTAVYFCNAVTYNGYTIWGQGTQVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGSGSDVQLVESGGGLVQAGGSLRLACAGSGRIFAIYDIAWYRHPPGNQRELVAMIRPVVTEIDYADSVKGRFTISRNNAMKTVYLQMNNLKPEDTAVYYCNAKRPWGSRDEYWGQGTQVTVSS

SEQ ID NO: 2198 - protein, 492 aa, Artificial Sequence
  Made in Lab - Nab-Nab-Fc construct
MDMRVPAQLLGLLLLWLRGARCDVQLVESGGGLVQAGGSLRLACAGSGRIFAIYDIAWYRHPPGNQRELVAMIRPVVTEIDYADSVKGRFTISRNNAMKTVYLQMNNLKPEDTAVYYCNAKRPWGSRDEYWGQGTQVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGKGGSGSDVQLVESGGGLVQAGGSLRLACAGSGRIFAIYDIAWYRHPPGNQRELVAMIRPVVTEIDYADSVKGRFTISRNNAMKTVYLQMNNLKPEDTAVYYCNAKRPWGSRDEYWGQGTQVTVSS

SEQ ID NO: 2199 - protein, 497 aa, Artificial Sequence
  Made in Lab - Nab-Nab-Fc construct
MDMRVPAQLLGLLLLWLRGARCAVQQVESGGGLVQPGGSLRLSCAASGFTLDYYAISWFRQAPGKKRELVADITSGGSTNYADSVKGRFTISRDNAKNTIYLQMNSLKPEDTAVYFCNAVTYNGYTIWGQGTQVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGKGGSGSAVQQVESGGGLVQPGGSLRLSCAASGFTLDYYAISWFRQAPGKKRELVADITSGGSTNYADSVKGRFTISRDNAKNTIYLQMNSLKPEDTAVYFCNAVTYNGYTIWGQGTQVTVSSGSGSGHHHHHH

SEQ ID NO: 2200 - protein, 741 aa, Artificial Sequence
  Made in lab - Tandem scFv-Fc construct
MDMRVPAQLLGLLLLWLRGARCEVQLVESGGGLVQPGGSLRLSCAASGFTFSHYTLSWVRQAPGKGLEWVSVISGDGSYTYYADSVKGRFTISSDNSKNTLYLQMNSLRAEDTAVYYCARNFIKYVFANWGQGTLVTVSSGGGGSGGGGSGGGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGSGSGDVKLVESGGGLVKLGGSLRLSCAASGFSFSTSYMSWVRQTPEKRLELVAAINLNGGSTYYSDTVKGRFTISRDNAKNTLYLQMSSLKSEDTAFYYCASELAGYGTPFAYWGQGTLVTVSAGSAASGSSGGSSSGADIVLTQSPATLSVTPGDSVSLSCKASQSISYNLHWYQQKSHESPRLLIKYTSQSISGIPSRFSGSGSGTDFTLTINNVETEDFGMYFCQQSNSWPLTFGAGTKLEVKGSGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2201 - protein, 746 aa, Artificial Sequence
  Made in lab - Tandem scFv-Fc construct
MDMRVPAQLLGLLLLWLRGARCEVQLVESGGGLVQPGGSLRLSCAASGFTFSHYTLSWVRQAPGKGLEWVSVISGDGSYTYYADSVKGRFTISSDNSKNTLYLQMNSLRAEDTAVYYCARNFIKYVFANWGQGTLVTVSSGGGGSGGGGSGGGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGSGSGGSGSGDVKLVESGGGLVKLGGSLRLSCAASGFSFSTSYMSWVRQTPEKRLELVAAINLNGGSTYYSDTVKGRFTISRDNAKNTLYLQMSSLKSEDTAFYYCASELAGYGTPFAYWGQGTLVTVSAGSAASGSSGGSSSGADIVLTQSPATLSVTPGDSVSLSCKASQSISYNLHWYQQKSHESPRLLIKYTSQSISGIPSRFSGSGSGTDFTLTINNVETEDFGMYFCQQSNSWPLTFGAGTKLEVKGSGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2202 - protein, 751 aa, Artificial Sequence
  Made in lab - Tandem scFv-Fc construct
MDMRVPAQLLGLLLLWLRGARCEVQLVESGGGLVQPGGSLRLSCAASGFTFSHYTLSWVRQAPGKGLEWVSVISGDGSYTYYADSVKGRFTISSDNSKNTLYLQMNSLRAEDTAVYYCARNFIKYVFANWGQGTLVTVSSGGGGSGGGGSGGGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGSGSGGSGSGGSSGGDVKLVESGGGLVKLGGSLRLSCAASGFSFSTSYMSWVRQTPEKRLELVAAINLNGGSTYYSDTVKGRFTISRDNAKNTLYLQMSSLKSEDTAFYYCASELAGYGTPFAYWGQGTLVTVSAGSAASGSSGGSSSGADIVLTQSPATLSVTPGDSVSLSCKASQSISYNLHWYQQKSHESPRLLIKYTSQSISGIPSRFSGSGSGTDFTLTINNVETEDFGMYFCQQSNSWPLTFGAGTKLEVKGSGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2203 - protein, 741 aa, Artificial Sequence
  Made in lab - Tandem scFv-Fc construct
MDMRVPAQLLGLLLLWLRGARCDVKLVESGGGLVKLGGSLRLSCAASGFSFSTSYMSWVRQTPEKRLELVAAINLNGGSTYYSDTVKGRFTISRDNAKNTLYLQMSSLKSEDTAFYYCASELAGYGTPFAYWGQGTLVTVSAGSAASGSSGGSSSGADIVLTQSPATLSVTPGDSVSLSCKASQSISYNLHWYQQKSHESPRLLIKYTSQSISGIPSRFSGSGSGTDFTLTINNVETEDFGMYFCQQSNSWPLTFGAGTKLEVKGSGSGEVQLVESGGGLVQPGGSLRLSCAASGFTFSHYTLSWVRQAPGKGLEWVSVISGDGSYTYYADSVKGRFTISSDNSKNTLYLQMNSLRAEDTAVYYCARNFIKYVFANWGQGTLVTVSSGGGGSGGGGSGGGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGSGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2204 - protein, 746 aa, Artificial Sequence
  Made in lab - Tandem scFv-Fc construct
MDMRVPAQLLGLLLLWLRGARCDVKLVESGGGLVKLGGSLRLSCAASGFSFSTSYMSWVRQTPEKRLELVAAINLNGGSTYYSDTVKGRFTISRDNAKNTLYLQMSSLKSEDTAFYYCASELAGYGTPFAYWGQGTLVTVSAGSAASGSSGGSSSGADIVLTQSPATLSVTPGDSVSLSCKASQSISYNLHWYQQKSHESPRLLIKYTSQSISGIPSRFSGSGSGTDFTLTINNVETEDFGMYFCQQSNSWPLTFGAGTKLEVKGSGSGGSGSGEVQLVESGGGLVQPGGSLRLSCAASGFTFSHYTLSWVRQAPGKGLEWVSVISGDGSYTYYADSVKGRFTISSDNSKNTLYLQMNSLRAEDTAVYYCARNFIKYVFANWGQGTLVTVSSGGGGSGGGGSGGGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGSGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2205 - protein, 751 aa, Artificial Sequence
  Made in lab - Tandem scFv-Fc construct
MDMRVPAQLLGLLLLWLRGARCDVKLVESGGGLVKLGGSLRLSCAASGFSFSTSYMSWVRQTPEKRLELVAAINLNGGSTYYSDTVKGRFTISRDNAKNTLYLQMSSLKSEDTAFYYCASELAGYGTPFAYWGQGTLVTVSAGSAASGSSGGSSSGADIVLTQSPATLSVTPGDSVSLSCKASQSISYNLHWYQQKSHESPRLLIKYTSQSISGIPSRFSGSGSGTDFTLTINNVETEDFGMYFCQQSNSWPLTFGAGTKLEVKGSGSGGSGSGGSSGGEVQLVESGGGLVQPGGSLRLSCAASGFTFSHYTLSWVRQAPGKGLEWVSVISGDGSYTYYADSVKGRFTISSDNSKNTLYLQMNSLRAEDTAVYYCARNFIKYVFANWGQGTLVTVSSGGGGSGGGGSGGGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGSGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2206 - protein, 747 aa, Artificial Sequence
  Made in lab - Tandem scFv-Fc construct
MDMRVPAQLLGLLLLWLRGARCEVQLVESGGGLVQPGGSLRLSCAASGFTFSHYTLSWVRQAPGKGLEWVSVISGDGSYTYYADSVKGRFTISSDNSKNTLYLQMNSLRAEDTAVYYCARNFIKYVFANWGQGTLVTVSSGGGGSGGGGSGGGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGSGSGEVQLVESGGGLVQPGGSLRLSCAASGFTFTSYYISWVRQAPGKGLEWVAEISPYSGSTYYADSVKGRFTISADTSKNTAYLQMNSLRAEDTAVYYCALRARPPIRLHPRGSVMDYWGQGTLVTVSSGSAASGSSGGSSSGADIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKGSGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2207 - protein, 752 aa, Artificial Sequence
  Made in lab - Tandem scFv-Fc construct
MDMRVPAQLLGLLLLWLRGARCEVQLVESGGGLVQPGGSLRLSCAASGFTFSHYTLSWVRQAPGKGLEWVSVISGDGSYTYYADSVKGRFTISSDNSKNTLYLQMNSLRAEDTAVYYCARNFIKYVFANWGQGTLVTVSSGGGGSGGGGSGGGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGSGSGGSGSGEVQLVESGGGLVQPGGSLRLSCAASGFTFTSYYISWVRQAPGKGLEWVAEISPYSGSTYYADSVKGRFTISADTSKNTAYLQMNSLRAEDTAVYYCALRARPPIRLHPRGSVMDYWGQGTLVTVSSGSAASGSSGGSSSGADIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKGSGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2208 - protein, 757 aa, Artificial Sequence
  Made in lab - Tandem scFv-Fc construct
MDMRVPAQLLGLLLLWLRGARCEVQLVESGGGLVQPGGSLRLSCAASGFTFSHYTLSWVRQAPGKGLEWVSVISGDGSYTYYADSVKGRFTISSDNSKNTLYLQMNSLRAEDTAVYYCARNFIKYVFANWGQGTLVTVSSGGGGSGGGGSGGGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGSGSGGSGSGGSSGGEVQLVESGGGLVQPGGSLRLSCAASGFTFTSYYISWVRQAPGKGLEWVAEISPYSGSTYYADSVKGRFTISADTSKNTAYLQMNSLRAEDTAVYYCALRARPPIRLHPRGSVMDYWGQGTLVTVSSGSAASGSSGGSSSGADIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKGSGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2209 - protein, 747 aa, Artificial Sequence
  Made in lab - Tandem scFv-Fc construct
MDMRVPAQLLGLLLLWLRGARCEVQLVESGGGLVQPGGSLRLSCAASGFTFTSYYISWVRQAPGKGLEWVAEISPYSGSTYYADSVKGRFTISADTSKNTAYLQMNSLRAEDTAVYYCALRARPPIRLHPRGSVMDYWGQGTLVTVSSGSAASGSSGGSSSGADIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKGSGSGEVQLVESGGGLVQPGGSLRLSCAASGFTFSHYTLSWVRQAPGKGLEWVSVISGDGSYTYYADSVKGRFTISSDNSKNTLYLQMNSLRAEDTAVYYCARNFIKYVFANWGQGTLVTVSSGGGGSGGGGSGGGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGSGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2210 - protein, 752 aa, Artificial Sequence
  Made in lab - Tandem scFv-Fc construct
MDMRVPAQLLGLLLLWLRGARCEVQLVESGGGLVQPGGSLRLSCAASGFTFTSYYISWVRQAPGKGLEWVAEISPYSGSTYYADSVKGRFTISADTSKNTAYLQMNSLRAEDTAVYYCALRARPPIRLHPRGSVMDYWGQGTLVTVSSGSAASGSSGGSSSGADIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKGSGSGGSGSGEVQLVESGGGLVQPGGSLRLSCAASGFTFSHYTLSWVRQAPGKGLEWVSVISGDGSYTYYADSVKGRFTISSDNSKNTLYLQMNSLRAEDTAVYYCARNFIKYVFANWGQGTLVTVSSGGGGSGGGGSGGGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGSGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2211 - protein, 757 aa, Artificial Sequence
  Made in lab - Tandem scFv-Fc construct
MDMRVPAQLLGLLLLWLRGARCEVQLVESGGGLVQPGGSLRLSCAASGFTFTSYYISWVRQAPGKGLEWVAEISPYSGSTYYADSVKGRFTISADTSKNTAYLQMNSLRAEDTAVYYCALRARPPIRLHPRGSVMDYWGQGTLVTVSSGSAASGSSGGSSSGADIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKGSGSGGSGSGGSSGGEVQLVESGGGLVQPGGSLRLSCAASGFTFSHYTLSWVRQAPGKGLEWVSVISGDGSYTYYADSVKGRFTISSDNSKNTLYLQMNSLRAEDTAVYYCARNFIKYVFANWGQGTLVTVSSGGGGSGGGGSGGGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGSGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2212 - protein, 741 aa, Artificial Sequence
  Made in lab - Tandem scFv-Fc construct
MDMRVPAQLLGLLLLWLRGARCEVQLVESGGGLVQPGGSLRLSCAASGFTFSHYTLSWVRQAPGKGLEWVSVISGDGSYTYYADSVKGRFTISSDNSKNTLYLQMNSLRAEDTAVYYCARNFIKYVFANWGQGTLVTVSSGGGGSGGGGSGGGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGSGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGSGSGDVKLVESGGGLVKLGGSLRLSCAASGFSFSTSYMSWVRQTPEKRLELVAAINLNGGSTYYSDTVKGRFTISRDNAKNTLYLQMSSLKSEDTAFYYCASELAGYGTPFAYWGQGTLVTVSAGSAASGSSGGSSSGADIVLTQSPATLSVTPGDSVSLSCKASQSISYNLHWYQQKSHESPRLLIKYTSQSISGIPSRFSGSGSGTDFTLTINNVETEDFGMYFCQQSNSWPLTFGAGTKLEVK

SEQ ID NO: 2213 - protein, 741 aa, Artificial Sequence
  Made in lab - Tandem scFv-Fc construct
MDMRVPAQLLGLLLLWLRGARCDVKLVESGGGLVKLGGSLRLSCAASGFSFSTSYMSWVRQTPEKRLELVAAINLNGGSTYYSDTVKGRFTISRDNAKNTLYLQMSSLKSEDTAFYYCASELAGYGTPFAYWGQGTLVTVSAGSAASGSSGGSSSGADIVLTQSPATLSVTPGDSVSLSCKASQSISYNLHWYQQKSHESPRLLIKYTSQSISGIPSRFSGSGSGTDFTLTINNVETEDFGMYFCQQSNSWPLTFGAGTKLEVKGSGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGSGSGEVQLVESGGGLVQPGGSLRLSCAASGFTFSHYTLSWVRQAPGKGLEWVSVISGDGSYTYYADSVKGRFTISSDNSKNTLYLQMNSLRAEDTAVYYCARNFIKYVFANWGQGTLVTVSSGGGGSGGGGSGGGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVL

SEQ ID NO: 2214 - protein, 238 aa, Artificial Sequence
  MAde in Lab - Fab-IgG construct
MDMRVPAQLLGLLLLWLRGARCQAVVLQEPSLSVSPGGTVTLTCGLSSGSVSTNYYPSWYQDTPGQDPRTLIYYTNTRSSDVPERFSGSIVGNKAALTITGAQPDDESVYFCLLYLGRGIWVFGGGTKLTVLGQPKAAPSVTLFPPSSEELQANKATLVCLISDFYPGAVTVAWKADSSPVKAGVETTTPSKQSNNKYAAKSYLSLTPEQWKSHRSYSCQVTHEGSTVEKTVAPTECS

SEQ ID NO: 2215 - protein, 235 aa, Artificial Sequence
  MAde in Lab - Fab-IgG construct
MDMRVPAQLLGLLLLWLRGARCQIVLTQSPAIMSASPGEKVTISCSANSSVRFMFWYQKKPGSKPKPLIYRTSNLASGVPARFSGSGSGTSYSLTISSMEAEDAATYYCQQYHSYPWTFGGGTKLEIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 2216 - protein, 700 aa, Artificial Sequence
  MAde in Lab - Fab-IgG construct
MDMRVPAQLLGLLLLWLRGARCQVQLQQSGPELVKPGASVRISCKASGYTFTTYYIHWLKDRPGQGLEWIGWIFPGNVNTKYNAKFKGKATLTADKSSSTAYMQLSSLTSEDSAVYFCAREELQYYFDYWGDGSTLTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCGSGSGEVQLVQSGAEVKKPGASVKVSCKASGYTFTSYGISWVRKAPGQGLEWMGWISAYNGNTNYAQKLQGRVTMTTDTSTSTAYMELRSLRSDDTAVYYCASSKEKATYYYGMDVWGKGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2217 - protein, 235 aa, Artificial Sequence
  MAde in Lab - Fab-IgG construct
MDMRVPAQLLGLLLLWLRGARCSYVLTQPPSVSVSPGQTASITCSGDKVGHKYASWYQDKPGQDPVLVIYEDSQRPSGIPVRFSGSNSGNTATLTISGTQAMDEADYYCQAWDSSTDVVFGGGTKLTVLGQPKAAPSVTLFPPSSEELQANKATLVCLISDFYPGAVTVAWKADSSPVKAGVETTTPSKQSNNKYAAKSYLSLTPEQWKSHRSYSCQVTHEGSTVEKTVAPTECS

SEQ ID NO: 2218 - protein, 236 aa, Artificial Sequence
  MAde in Lab - Fab-IgG construct
MDMRVPAQLLGLLLLWLRGARCDIQMTQSPSSLSASVGDRVTITCRASQSISSYLNWYQKKPGKKPKLLIYAASSLQSGVPSRFSGSGSGTDFTLTISSLQPEDFATYYCQQSYSTPLTFGGGTKVEIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 2219 - protein, 707 aa, Artificial Sequence
  MAde in Lab - Fab-IgG construct
MDMRVPAQLLGLLLLWLRGARCQVQLQQWGAGLLKPSETLSLTCAVSGASFSGHYWTWIRKPPGKGLEWIGEIDHTGSTNYEPSLRSRVTISVDTSKNQFSLNLKSVTAADTAVYYCARGGQGGYDWGHYHGLDVWGKGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCGSGSGEVQLVESGGGLVQPGGSLRLSCAASGFTFSSYAMHWVRDAPGKGLEWVASISSTSGSKYYADSVKGRFTISRDNSKNTLYLQMNSLRAEDTAVYSCAKTYYDFWSGYYTFDYWGDGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2220 - protein, 235 aa, Artificial Sequence; identical to SEQ ID NO: 2217
  MAde in Lab - Fab-IgG construct

SEQ ID NO: 2221 - protein, 236 aa, Artificial Sequence; identical to SEQ ID NO: 2218
  MAde in Lab - Fab-IgG construct

SEQ ID NO: 2222 - protein, 712 aa, Artificial Sequence
  MAde in Lab - Fab-IgG construct
MDMRVPAQLLGLLLLWLRGARCQVQLQQWGAGLLKPSETLSLTCAVSGASFSGHYWTWIRKPPGKGLEWIGEIDHTGSTNYEPSLRSRVTISVDTSKNQFSLNLKSVTAADTAVYYCARGGQGGYDWGHYHGLDVWGKGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCGSGSGGSGSGEVQLVESGGGLVQPGGSLRLSCAASGFTFSSYAMHWVRDAPGKGLEWVASISSTSGSKYYADSVKGRFTISRDNSKNTLYLQMNSLRAEDTAVYSCAKTYYDFWSGYYTFDYWGDGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2223 - protein, 235 aa, Artificial Sequence; identical to SEQ ID NO: 2217
  MAde in Lab - Fab-IgG construct

SEQ ID NO: 2224 - protein, 236 aa, Artificial Sequence; identical to SEQ ID NO: 2218
  MAde in Lab - Fab-IgG construct

SEQ ID NO: 2225 - protein, 717 aa, Artificial Sequence
  MAde in Lab - Fab-IgG construct
MDMRVPAQLLGLLLLWLRGARCQVQLQQWGAGLLKPSETLSLTCAVSGASFSGHYWTWIRKPPGKGLEWIGEIDHTGSTNYEPSLRSRVTISVDTSKNQFSLNLKSVTAADTAVYYCARGGQGGYDWGHYHGLDVWGKGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCGSGSGGSGSGGSSGGEVQLVESGGGLVQPGGSLRLSCAASGFTFSSYAMHWVRDAPGKGLEWVASISSTSGSKYYADSVKGRFTISRDNSKNTLYLQMNSLRAEDTAVYSCAKTYYDFWSGYYTFDYWGDGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2226 - protein, 235 aa, Artificial Sequence; identical to SEQ ID NO: 2217
  MAde in Lab - Fab-IgG construct

SEQ ID NO: 2227 - protein, 236 aa, Artificial Sequence
  MAde in Lab - Fab-IgG construct
MDMRVPAQLLGLLLLWLRGARCDIQMTQSPSSLSAYVGDRVTITCRVSQGISSYLNWYQKKPGKKPKLLIYAASSLQSGVPSRFSGSGSGTDFTLTISSLQPEDFATYYCQQTYTIPFTFGPGTKVDIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 2228 - protein, 705 aa, Artificial Sequence
  MAde in Lab - Fab-IgG construct
MDMRVPAQLLGLLLLWLRGARCQVQLQQWGAGLLKPSETLSLTCAVSGASFSGHYWTWIRKPPGKGLEWIGEIDHTGSTNYEPSLRSRVTISVDTSKNQFSLNLKSVTAADTAVYYCARGGQGGYDWGHYHGLDVWGKGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCGSGSGEVQLVESVGGLVQPGGSLRLSCAASGFTFSSYAMHWVRDAPGKGLEWISTISGSGGSTYYADSVKGRFTISRDNSKNTLYLQMNSLRAEDTAVYYCARAGYGRYYYGMDVWGDGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2229 - protein, 235 aa, Artificial Sequence; identical to SEQ ID NO: 2217
  MAde in Lab - Fab-IgG construct

SEQ ID NO: 2230 - protein, 236 aa, Artificial Sequence; identical to SEQ ID NO: 2227
  MAde in Lab - Fab-IgG construct

SEQ ID NO: 2231 - protein, 710 aa, Artificial Sequence
  MAde in Lab - Fab-IgG construct
MDMRVPAQLLGLLLLWLRGARCQVQLQQWGAGLLKPSETLSLTCAVSGASFSGHYWTWIRKPPGKGLEWIGEIDHTGSTNYEPSLRSRVTISVDTSKNQFSLNLKSVTAADTAVYYCARGGQGGYDWGHYHGLDVWGKGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCGSGSGGSGSGEVQLVESVGGLVQPGGSLRLSCAASGFTFSSYAMHWVRDAPGKGLEWISTISGSGGSTYYADSVKGRFTISRDNSKNTLYLQMNSLRAEDTAVYYCARAGYGRYYYGMDVWGDGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2232 - protein, 235 aa, Artificial Sequence; identical to SEQ ID NO: 2217
  MAde in Lab - Fab-IgG construct

SEQ ID NO: 2233 - protein, 236 aa, Artificial Sequence; identical to SEQ ID NO: 2227
  MAde in Lab - Fab-IgG construct

SEQ ID NO: 2234 - protein, 715 aa, Artificial Sequence
  MAde in Lab - Fab-IgG construct
MDMRVPAQLLGLLLLWLRGARCQVQLQQWGAGLLKPSETLSLTCAVSGASFSGHYWTWIRKPPGKGLEWIGEIDHTGSTNYEPSLRSRVTISVDTSKNQFSLNLKSVTAADTAVYYCARGGQGGYDWGHYHGLDVWGKGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCGSGSGGSGSGGSSGGEVQLVESVGGLVQPGGSLRLSCAASGFTFSSYAMHWVRDAPGKGLEWISTISGSGGSTYYADSVKGRFTISRDNSKNTLYLQMNSLRAEDTAVYYCARAGYGRYYYGMDVWGDGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2235 - protein, 236 aa, Artificial Sequence; identical to SEQ ID NO: 2227
  MAde in Lab - Fab-IgG construct

SEQ ID NO: 2236 - protein, 235 aa, Artificial Sequence; identical to SEQ ID NO: 2217
  MAde in Lab - Fab-IgG construct

SEQ ID NO: 2237 - protein, 705 aa, Artificial Sequence
  MAde in Lab - Fab-IgG construct
MDMRVPAQLLGLLLLWLRGARCEVQLVESVGGLVQPGGSLRLSCAASGFTFSSYAMHWVRDAPGKGLEWISTISGSGGSTYYADSVKGRFTISRDNSKNTLYLQMNSLRAEDTAVYYCARAGYGRYYYGMDVWGDGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCGSGSGQVQLQQWGAGLLKPSETLSLTCAVSGASFSGHYWTWIRKPPGKGLEWIGEIDHTGSTNYEPSLRSRVTISVDTSKNQFSLNLKSVTAADTAVYYCARGGQGGYDWGHYHGLDVWGKGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2238 - protein, 236 aa, Artificial Sequence; identical to SEQ ID NO: 2227
  MAde in Lab - Fab-IgG construct

SEQ ID NO: 2239 - protein, 235 aa, Artificial Sequence; identical to SEQ ID NO: 2217
  MAde in Lab - Fab-IgG construct

SEQ ID NO: 2240 - protein, 710 aa, Artificial Sequence
  MAde in Lab - Fab-IgG construct
MDMRVPAQLLGLLLLWLRGARCEVQLVESVGGLVQPGGSLRLSCAASGFTFSSYAMHWVRDAPGKGLEWISTISGSGGSTYYADSVKGRFTISRDNSKNTLYLQMNSLRAEDTAVYYCARAGYGRYYYGMDVWGDGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCGSGSGGSGSGQVQLQQWGAGLLKPSETLSLTCAVSGASFSGHYWTWIRKPPGKGLEWIGEIDHTGSTNYEPSLRSRVTISVDTSKNQFSLNLKSVTAADTAVYYCARGGQGGYDWGHYHGLDVWGKGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2241 - protein, 236 aa, Artificial Sequence; identical to SEQ ID NO: 2227
  MAde in Lab - Fab-IgG construct

SEQ ID NO: 2242 - protein, 235 aa, Artificial Sequence; identical to SEQ ID NO: 2217
  MAde in Lab - Fab-IgG construct

SEQ ID NO: 2243 - protein, 715 aa, Artificial Sequence
  MAde in Lab - Fab-IgG construct
MDMRVPAQLLGLLLLWLRGARCEVQLVESVGGLVQPGGSLRLSCAASGFTFSSYAMHWVRDAPGKGLEWISTISGSGGSTYYADSVKGRFTISRDNSKNTLYLQMNSLRAEDTAVYYCARAGYGRYYYGMDVWGDGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCGSGSGGSGSGGSSGGQVQLQQWGAGLLKPSETLSLTCAVSGASFSGHYWTWIRKPPGKGLEWIGEIDHTGSTNYEPSLRSRVTISVDTSKNQFSLNLKSVTAADTAVYYCARGGQGGYDWGHYHGLDVWGKGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2244 - protein, 260 aa, Artificial Sequence
  MAde in Lab - Fab-IgG construct
MDMRVPAQLLGLLLLWLRGARCQVQLQQWGAGLLKPSETLSLTCAVSGASFSGHYWTWIRQPPGKGLEWIGEIDHTGSTNYEPSLRSRVTISVDTSKNQFSLNLKSVTAADTAVYYCARGGQGGYDWGHYHGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGSGSGHHHHHH

SEQ ID NO: 2245 - protein, 236 aa, Artificial Sequence
  MAde in Lab - Fab-IgG construct
MDMRVPAQLLGLLLLWLRGARCDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2246 - protein, 693 aa, Artificial Sequence
  MAde in Lab - Fab-IgG construct
MDMRVPAQLLGLLLLWLRGARCSYVLTQPPSVSVSPGQTASITCSGDKVGHKYASWYQQKPGQSPVLVIYEDSQRPSGIPVRFSGSNSGNTATLTISGTQAMDEADYYCQAWDSSTDVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECSGSGSGEVQLVESGGGLVQPGGSLRLSCAASGFTFSSYAMHWVRQAPGKGLEWVASISSTSGSKYYADSVKGRFTISRDNSKNTLYLQMNSLRAEDTAVYSCAKTYYDFWSGYYTFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2247 - protein, 256 aa, Artificial Sequence
  MAde in Lab - Fab-IgG construct
MDMRVPAQLLGLLLLWLRGARCDVKLVESGGGLVKLGGSLRLSCAASGFSFSTSYMSWVRQTPEKRLELVAAINLNGGSTYYSDTVKGRFTISRDNAKNTLYLQMSSLKSEDTAFYYCASELAGYGTPFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGSGSGHHHHHH

SEQ ID NO: 2248 - protein, 707 aa, Artificial Sequence
  MAde in Lab - Fab-IgG construct
MDMRVPAQLLGLLLLWLRGARCAAADIVLTQSPATLSVTPGDSVSLSCKASQSISYNLHWYQQKSHESPRLLIKYTSQSISGIPSRFSGSGSGTDFTLTINNVETEDFGMYFCQQSNSWPLTFGAGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCASSKEKATYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGSGSGHHHHHH

SEQ ID NO: 2249 - protein, 712 aa, Artificial Sequence
  MAde in Lab - Fab-IgG construct
MDMRVPAQLLGLLLLWLRGARCAAADIVLTQSPATLSVTPGDSVSLSCKASQSISYNLHWYQQKSHESPRLLIKYTSQSISGIPSRFSGSGSGTDFTLTINNVETEDFGMYFCQQSNSWPLTFGAGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSEVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCASSKEKATYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGSGSGHHHHHH

SEQ ID NO: 2250 - protein, 747 aa, Artificial Sequence
  Made in lab - Tandem scFv-Fc construct
MDMRVPAQLLGLLLLWLRGARCEVQLVESGGGLVQPGGSLRLSCAASGFTFSHYTLSWVRQAPGKGLEWVSVISGDGSYTYYADSVKGRFTISSDNSKNTLYLQMNSLRAEDTAVYYCARNFIKYVFANWGQGTLVTVSSGGGGSGGGGSGGGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGSGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGSGSGEVQLVESGGGLVQPGGSLRLSCAASGFTFTSYYISWVRQAPGKGLEWVAEISPYSGSTYYADSVKGRFTISADTSKNTAYLQMNSLRAEDTAVYYCALRARPPIRLHPRGSVMDYWGQGTLVTVSSGSAASGSSGGSSSGADIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIK

SEQ ID NO: 2251 - protein, 263 aa, Artificial Sequence
  Made in Lab - R2M3-26F(ab')2 Fd construct
MDMRVPAQLLGLLLLWLRGARCEVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCASSKEKATYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAG

SEQ ID NO: 2252 - protein, 347 aa, Artificial Sequence
  Made in Lab - 10SG11-1RC07 LC  construct
MDMRVPAQLLGLLLLWLRGARCDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKGSGSGSYVLTQPPSVSVSPGQTASITCSGDKVGHKYASWYQQKPGQSPVLVIYEDSQRPSGIPVRFSGSNSGNTATLTISGTQAMDEADYYCQAWDSSTDVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 2253 - protein, 597 aa, Artificial Sequence
  Made in Lab - 10SG11-1RC07 HC  construct
MDMRVPAQLLGLLLLWLRGARCQVQLVQSGAEVKKPGSSVKVSCKASGYTFTYRYLHWVRQAPGQGLEWMGRIIPVLKITNYAQKFQGRVTITADESTSTAYMELSSLRSEDTAVYYCAVVDDAFDIWGQGTMVTVSSGSGSGQVQLQQWGAGLLKPSETLSLTCAVSGASFSGHYWTWIRQPPGKGLEWIGEIDHTGSTNYEPSLRSRVTISVDTSKNQFSLNLKSVTAADTAVYYCARGGQGGYDWGHYHGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2254 - protein, 474 aa, Artificial Sequence
  Made in Lab - R2M3-26 CL, and R2M3-26 NL Heavy chain construct
MDMRVPAQLLGLLLLWLRGARCEVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCASSKEKATYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2255 - protein, 520 aa, Artificial Sequence
  Made in lab - 18R5:5:1115.3:His construct
MDMRVPAQLLGLLLLWLRGARCEVQLVESGGGLVQPGGSLRLSCAASGFTFSHYTLSWVRQAPGKGLEWVSVISGDGSYTYYADSVKGRFTISSDNSKNTLYLQMNSLRAEDTAVYYCARNFIKYVFANWGQGTLVTVSSGGGGSGGGGSGGGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGSGSGDVKLVESGGGLVKLGGSLRLSCAASGFSFSTSYMSWVRQTPEKRLELVAAINLNGGSTYYSDTVKGRFTISRDNAKNTLYLQMSSLKSEDTAFYYCASELAGYGTPFAYWGQGTLVTVSAGSAASGSSGGSSSGADIVLTQSPATLSVTPGDSVSLSCKASQSISYNLHWYQQKSHESPRLLIKYTSQSISGIPSRFSGSGSGTDFTLTINNVETEDFGMYFCQQSNSWPLTFGAGTKLEVKGSGSGHHHHHH

SEQ ID NO: 2256 - protein, 525 aa, Artificial Sequence
  Made in Lab - 18R5:10:1115.3:His construct
MDMRVPAQLLGLLLLWLRGARCEVQLVESGGGLVQPGGSLRLSCAASGFTFSHYTLSWVRQAPGKGLEWVSVISGDGSYTYYADSVKGRFTISSDNSKNTLYLQMNSLRAEDTAVYYCARNFIKYVFANWGQGTLVTVSSGGGGSGGGGSGGGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGSGSGGSGSGDVKLVESGGGLVKLGGSLRLSCAASGFSFSTSYMSWVRQTPEKRLELVAAINLNGGSTYYSDTVKGRFTISRDNAKNTLYLQMSSLKSEDTAFYYCASELAGYGTPFAYWGQGTLVTVSAGSAASGSSGGSSSGADIVLTQSPATLSVTPGDSVSLSCKASQSISYNLHWYQQKSHESPRLLIKYTSQSISGIPSRFSGSGSGTDFTLTINNVETEDFGMYFCQQSNSWPLTFGAGTKLEVKGSGSGHHHHHH

SEQ ID NO: 2257 - protein, 530 aa, Artificial Sequence
  Made in lab - 18R5:15:1115.3:His construct
MDMRVPAQLLGLLLLWLRGARCEVQLVESGGGLVQPGGSLRLSCAASGFTFSHYTLSWVRQAPGKGLEWVSVISGDGSYTYYADSVKGRFTISSDNSKNTLYLQMNSLRAEDTAVYYCARNFIKYVFANWGQGTLVTVSSGGGGSGGGGSGGGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGSGSGGSGSGGSSGGDVKLVESGGGLVKLGGSLRLSCAASGFSFSTSYMSWVRQTPEKRLELVAAINLNGGSTYYSDTVKGRFTISRDNAKNTLYLQMSSLKSEDTAFYYCASELAGYGTPFAYWGQGTLVTVSAGSAASGSSGGSSSGADIVLTQSPATLSVTPGDSVSLSCKASQSISYNLHWYQQKSHESPRLLIKYTSQSISGIPSRFSGSGSGTDFTLTINNVETEDFGMYFCQQSNSWPLTFGAGTKLEVKGSGSGHHHHHH

SEQ ID NO: 2258 - protein, 520 aa, Artificial Sequence
  Made in Lab - 1115.3:5:18R5:His construct
MDMRVPAQLLGLLLLWLRGARCDVKLVESGGGLVKLGGSLRLSCAASGFSFSTSYMSWVRQTPEKRLELVAAINLNGGSTYYSDTVKGRFTISRDNAKNTLYLQMSSLKSEDTAFYYCASELAGYGTPFAYWGQGTLVTVSAGSAASGSSGGSSSGADIVLTQSPATLSVTPGDSVSLSCKASQSISYNLHWYQQKSHESPRLLIKYTSQSISGIPSRFSGSGSGTDFTLTINNVETEDFGMYFCQQSNSWPLTFGAGTKLEVKGSGSGEVQLVESGGGLVQPGGSLRLSCAASGFTFSHYTLSWVRQAPGKGLEWVSVISGDGSYTYYADSVKGRFTISSDNSKNTLYLQMNSLRAEDTAVYYCARNFIKYVFANWGQGTLVTVSSGGGGSGGGGSGGGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGSGSGHHHHHH

SEQ ID NO: 2259 - protein, 525 aa, Artificial Sequence
  Made in Lab - 1115.3:10:18R5:His construct
MDMRVPAQLLGLLLLWLRGARCDVKLVESGGGLVKLGGSLRLSCAASGFSFSTSYMSWVRQTPEKRLELVAAINLNGGSTYYSDTVKGRFTISRDNAKNTLYLQMSSLKSEDTAFYYCASELAGYGTPFAYWGQGTLVTVSAGSAASGSSGGSSSGADIVLTQSPATLSVTPGDSVSLSCKASQSISYNLHWYQQKSHESPRLLIKYTSQSISGIPSRFSGSGSGTDFTLTINNVETEDFGMYFCQQSNSWPLTFGAGTKLEVKGSGSGGSGSGEVQLVESGGGLVQPGGSLRLSCAASGFTFSHYTLSWVRQAPGKGLEWVSVISGDGSYTYYADSVKGRFTISSDNSKNTLYLQMNSLRAEDTAVYYCARNFIKYVFANWGQGTLVTVSSGGGGSGGGGSGGGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGSGSGHHHHHH

SEQ ID NO: 2260 - protein, 530 aa, Artificial Sequence
  Made in Lab - 1115.3:15:18R5:His construct
MDMRVPAQLLGLLLLWLRGARCDVKLVESGGGLVKLGGSLRLSCAASGFSFSTSYMSWVRQTPEKRLELVAAINLNGGSTYYSDTVKGRFTISRDNAKNTLYLQMSSLKSEDTAFYYCASELAGYGTPFAYWGQGTLVTVSAGSAASGSSGGSSSGADIVLTQSPATLSVTPGDSVSLSCKASQSISYNLHWYQQKSHESPRLLIKYTSQSISGIPSRFSGSGSGTDFTLTINNVETEDFGMYFCQQSNSWPLTFGAGTKLEVKGSGSGGSGSGGSSGGEVQLVESGGGLVQPGGSLRLSCAASGFTFSHYTLSWVRQAPGKGLEWVSVISGDGSYTYYADSVKGRFTISSDNSKNTLYLQMNSLRAEDTAVYYCARNFIKYVFANWGQGTLVTVSSGGGGSGGGGSGGGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGSGSGHHHHHH

SEQ ID NO: 2261 - protein, 526 aa, Artificial Sequence
  Made in Lab - 18R5:5:YW211.31.57:His construct
MDMRVPAQLLGLLLLWLRGARCEVQLVESGGGLVQPGGSLRLSCAASGFTFSHYTLSWVRQAPGKGLEWVSVISGDGSYTYYADSVKGRFTISSDNSKNTLYLQMNSLRAEDTAVYYCARNFIKYVFANWGQGTLVTVSSGGGGSGGGGSGGGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGSGSGEVQLVESGGGLVQPGGSLRLSCAASGFTFTSYYISWVRQAPGKGLEWVAEISPYSGSTYYADSVKGRFTISADTSKNTAYLQMNSLRAEDTAVYYCALRARPPIRLHPRGSVMDYWGQGTLVTVSSGSAASGSSGGSSSGADIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKGSGSGHHHHHH

SEQ ID NO: 2262 - protein, 531 aa, Artificial Sequence
  Made in Lab - 18R5:10:YW211.31.57:His construct
MDMRVPAQLLGLLLLWLRGARCEVQLVESGGGLVQPGGSLRLSCAASGFTFSHYTLSWVRQAPGKGLEWVSVISGDGSYTYYADSVKGRFTISSDNSKNTLYLQMNSLRAEDTAVYYCARNFIKYVFANWGQGTLVTVSSGGGGSGGGGSGGGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGSGSGGSGSGEVQLVESGGGLVQPGGSLRLSCAASGFTFTSYYISWVRQAPGKGLEWVAEISPYSGSTYYADSVKGRFTISADTSKNTAYLQMNSLRAEDTAVYYCALRARPPIRLHPRGSVMDYWGQGTLVTVSSGSAASGSSGGSSSGADIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKGSGSGHHHHHH

SEQ ID NO: 2263 - protein, 536 aa, Artificial Sequence
  Made in Lab - 18R5:15:YW211.31.57:His construct
MDMRVPAQLLGLLLLWLRGARCEVQLVESGGGLVQPGGSLRLSCAASGFTFSHYTLSWVRQAPGKGLEWVSVISGDGSYTYYADSVKGRFTISSDNSKNTLYLQMNSLRAEDTAVYYCARNFIKYVFANWGQGTLVTVSSGGGGSGGGGSGGGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGSGSGGSGSGGSSGGEVQLVESGGGLVQPGGSLRLSCAASGFTFTSYYISWVRQAPGKGLEWVAEISPYSGSTYYADSVKGRFTISADTSKNTAYLQMNSLRAEDTAVYYCALRARPPIRLHPRGSVMDYWGQGTLVTVSSGSAASGSSGGSSSGADIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKGSGSGHHHHHH

SEQ ID NO: 2264 - protein, 526 aa, Artificial Sequence
  Made in Lab - YW211.31.57:5:18R5:His construct
MDMRVPAQLLGLLLLWLRGARCEVQLVESGGGLVQPGGSLRLSCAASGFTFTSYYISWVRQAPGKGLEWVAEISPYSGSTYYADSVKGRFTISADTSKNTAYLQMNSLRAEDTAVYYCALRARPPIRLHPRGSVMDYWGQGTLVTVSSGSAASGSSGGSSSGADIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKGSGSGEVQLVESGGGLVQPGGSLRLSCAASGFTFSHYTLSWVRQAPGKGLEWVSVISGDGSYTYYADSVKGRFTISSDNSKNTLYLQMNSLRAEDTAVYYCARNFIKYVFANWGQGTLVTVSSGGGGSGGGGSGGGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGSGSGHHHHHH

SEQ ID NO: 2265 - protein, 531 aa, Artificial Sequence
  Made in Lab - YW211.31.57:10:18R5:His construct
MDMRVPAQLLGLLLLWLRGARCEVQLVESGGGLVQPGGSLRLSCAASGFTFTSYYISWVRQAPGKGLEWVAEISPYSGSTYYADSVKGRFTISADTSKNTAYLQMNSLRAEDTAVYYCALRARPPIRLHPRGSVMDYWGQGTLVTVSSGSAASGSSGGSSSGADIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKGSGSGGSGSGEVQLVESGGGLVQPGGSLRLSCAASGFTFSHYTLSWVRQAPGKGLEWVSVISGDGSYTYYADSVKGRFTISSDNSKNTLYLQMNSLRAEDTAVYYCARNFIKYVFANWGQGTLVTVSSGGGGSGGGGSGGGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGSGSGHHHHHH

SEQ ID NO: 2266 - protein, 536 aa, Artificial Sequence
  Made in Lab - YW211.31.57:15:18R5:His construct
MDMRVPAQLLGLLLLWLRGARCEVQLVESGGGLVQPGGSLRLSCAASGFTFTSYYISWVRQAPGKGLEWVAEISPYSGSTYYADSVKGRFTISADTSKNTAYLQMNSLRAEDTAVYYCALRARPPIRLHPRGSVMDYWGQGTLVTVSSGSAASGSSGGSSSGADIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKGSGSGGSGSGGSSGGEVQLVESGGGLVQPGGSLRLSCAASGFTFSHYTLSWVRQAPGKGLEWVSVISGDGSYTYYADSVKGRFTISSDNSKNTLYLQMNSLRAEDTAVYYCARNFIKYVFANWGQGTLVTVSSGGGGSGGGGSGGGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGSGSGHHHHHH

SEQ ID NO: 2267 - protein, 747 aa, Artificial Sequence
  Made in Lab - YW211.31.57:Fc:18R5 construct
MDMRVPAQLLGLLLLWLRGARCEVQLVESGGGLVQPGGSLRLSCAASGFTFTSYYISWVRQAPGKGLEWVAEISPYSGSTYYADSVKGRFTISADTSKNTAYLQMNSLRAEDTAVYYCALRARPPIRLHPRGSVMDYWGQGTLVTVSSGSAASGSSGGSSSGADIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKGSGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGSGSGEVQLVESGGGLVQPGGSLRLSCAASGFTFSHYTLSWVRQAPGKGLEWVSVISGDGSYTYYADSVKGRFTISSDNSKNTLYLQMNSLRAEDTAVYYCARNFIKYVFANWGQGTLVTVSSGGGGSGGGGSGGGGSDIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVL

What is claimed is:

1. A soluble, multivalent, multispecific Wnt surrogate molecule, wherein the Wnt surrogate molecule comprises:
   (i) one or more Fzd binding regions that specifically binds to one or more Frizzled (Fzd) receptors, wherein the one or more Fzd binding regions comprise one or more antibody or antigen-binding fragment of the antibody, wherein the one or more antibody or the antigen-binding fragment comprises: a CDRH1 of SEQ ID NO: 307, a CDRH2 of SEQ ID NO: 501, a CDRH3 of SEQ ID NO: 964, a CDRL1 of SEQ ID NO: 1098, a CDRL2 of SEQ ID NO: 1175, and a CDRL3 of SEQ ID NO: 1372; and
   (ii) one or more LRP5/6 binding regions that specifically binds to a Low-density lipoprotein (LDL) receptor-related protein 5 (LRP5) and/or a Low-density lipoprotein (LDL) receptor-related protein 6 (LRP6), wherein the one or more LRP5/6 binding regions comprise one or more antibody or antigen-binding fragment of the antibody, wherein the one or more antibody or the antigen-binding fragment comprises: a CDRH1 of SEQ ID NO: 1618, a CDRH2 of SEQ ID NO: 1715, and a CDRH3 of SEQ ID NO: 2012.

2. The Wnt surrogate molecule of claim 1, wherein the Wnt surrogate molecule comprises one or more polypeptides having at least 90% identity to the sequence set forth in SEQ ID NO: 137 and one or more polypeptide having at least 90% identity to the sequence set forth in SEQ ID NO: 153.

3. The Wnt surrogate molecule of claim 1, wherein the Fzd binding region comprises a full immunoglobulin G (IgG), comprising two light chains and two heavy chains, and the LRP5/6 binding region comprises a VHH.

4. The Wnt surrogate molecule of claim 3, wherein each of the one or more LRP5/6 binding regions is fused to the N-terminus of one of the light chains.

5. A pharmaceutical composition comprising a physiologically acceptable excipient, diluent, or carrier, and the Wnt surrogate molecule according to claim 1.

6. The Wnt Surrogate molecule of claim 4, wherein each of the one or more LRP5/6 binding regions is fused to one of the light chains via a linker moiety.

7. The Wnt surrogate molecule of claim 6, wherein the Wnt surrogate molecule comprises:
   (i) two Fzd binding regions, wherein each of the Fzd binding regions comprise one or more antibody or antigen-binding fragment thereof, wherein the one or more antibody or the antigen-binding fragment thereof comprises: a CDRH1 of SEQ ID NO: 307, a CDRH2 of SEQ ID NO: 501, a CDRH3 of SEQ ID NO: 964, a CDRL1 of SEQ ID NO: 1098, a CDRL2 of SEQ ID NO: 1175, and a CDRL3 of SEQ ID NO: 1372; and
   (ii) two LRP5/6 binding regions, wherein each of the LRP5/6 binding regions comprise one or more antibody or antigen-binding fragment thereof, wherein the one or more antibody or the antigen-binding fragment thereof comprises: a CDRH1 of SEQ ID NO: 1618, a CDRH2 of SEQ ID NO: 1715, and a CDRH3 of SEQ ID NO: 2012.

8. The Wnt surrogate molecule of claim 6, wherein the Wnt surrogate molecule comprises two polypeptides having at least 90% identity to the sequence set forth in SEQ ID NO: 137 and two polypeptides having at least 90% identity to the sequence set forth in SEQ ID NO: 153.

9. A pharmaceutical composition comprising the physiologically acceptable excipient, diluent, or carrier, and the Wnt surrogate molecule of claim 7.

10. A pharmaceutical composition comprising the physiologically acceptable excipient, diluent, or carrier, and the Wnt surrogate molecule of claim 8.

* * * * *